US010005821B2

(12) United States Patent
Das Gupta et al.

(10) Patent No.: US 10,005,821 B2
(45) Date of Patent: *Jun. 26, 2018

(54) MODIFICATIONS OF CUPREDOXIN DERIVED PEPTIDES AND METHODS OF USE THEREOF

(75) Inventors: Tapas Das Gupta, River Forest, IL (US); Ananda Chakrabarty, Villa Park, IL (US)

(73) Assignee: THE BOARD OF TRUSTEES OF THE UNIVERSITY OF ILLINOIS, Urbana, IL (US)

( * ) Notice: Subject to any disclaimer, the term of this patent is extended or adjusted under 35 U.S.C. 154(b) by 1240 days.

This patent is subject to a terminal disclaimer.

(21) Appl. No.: 11/853,497

(22) Filed: Sep. 11, 2007

(65) Prior Publication Data

US 2010/0267608 A1   Oct. 21, 2010

Related U.S. Application Data

(63) Continuation-in-part of application No. 11/244,105, filed on Oct. 6, 2005, now Pat. No. 7,691,383.

(60) Provisional application No. 60/843,388, filed on Sep. 11, 2006, provisional application No. 60/616,782, filed on Oct. 7, 2004, provisional application No. 60/680,500, filed on May 13, 2005, provisional application No. 60/700,297, filed on Jul. 19, 2005.

(51) Int. Cl.
| | |
|---|---|
| C07K 14/21 | (2006.01) |
| A61K 38/00 | (2006.01) |
| C07K 7/00 | (2006.01) |
| A61K 38/04 | (2006.01) |
| A61K 38/08 | (2006.01) |
| A61K 38/10 | (2006.01) |
| A61K 38/16 | (2006.01) |

(52) U.S. Cl.
CPC .............. *C07K 14/21* (2013.01); *A61K 38/04* (2013.01); *A61K 38/08* (2013.01); *A61K 38/10* (2013.01); *A61K 38/164* (2013.01); *C07K 7/00* (2013.01); *A61K 38/00* (2013.01)

(58) Field of Classification Search
None
See application file for complete search history.

(56) References Cited

U.S. PATENT DOCUMENTS

| | | | | |
|---|---|---|---|---|
| 7,556,810 B2 * | 7/2009 | Mehta et al. | ............. | 424/185.1 |
| 2004/0132966 A1 | 7/2004 | Miranda | | |
| 2006/0040269 A1 | 2/2006 | Chakrabarty et al. | | |
| 2006/0149037 A1 | 7/2006 | Chakrabarty et al. | | |
| 2007/0054337 A1 | 3/2007 | Ferning et al. | | |
| 2007/0161569 A1 | 7/2007 | Gardella | | |
| 2008/0194697 A1 | 8/2008 | Frydman et al. | | |
| 2008/0293619 A1 | 11/2008 | Chakrabarty et al. | | |
| 2009/0042246 A1 | 2/2009 | Moll et al. | | |

FOREIGN PATENT DOCUMENTS

| | | | |
|---|---|---|---|
| CN | 1506375 A | * | 6/2004 |
| WO | WO 2005/018662 | * | 3/2005 |

OTHER PUBLICATIONS

Roberts et al., Advanced Drug Delivery Reviews, 2002, 54:459-476.*
Rizzuti et al., Journal of Molecular Modeling, 2004, 10:25-31.*
Schafmeister et al., J. Am. Chem. Soc., 2000, 122:5891-5892.*
Andrews et al., Tetrahedron, 1999, 55:11711-11743.*
Mitsutake et al., Journal of Chemical Physics, 2000, 112(23):10638-10647.*
Kinnear et al., J. Am. Chem. Soc., 2001, 123:7907-7908.*
Werle et al., Amino Acids, 2006, 30:351-367.*
Pace et al., Biophysical Journal, 1998, 75:422-427.*
Kim et al., Biochemistry 45(31):9434-44 (2006).
DATABASE accession No. Q02F96 EBI accession No. UNIPROT:Q02F96 UniProt [Online] Nov. 14, 2006 "SubName:Full=Azurin:" (2006).

* cited by examiner

*Primary Examiner* — Nicole Kinsey White
(74) *Attorney, Agent, or Firm* — Benesch, Friedlander, Coplan & Aronoff LLP

(57) ABSTRACT

The present invention provides modified cupredoxin derived peptides with pharmacologic activity that have improved pharmacokinetic properties, and methods to use them to treat mammals suffering from various conditions related to the pharmacologic activities. Modifications of the cupredoxin derived peptides include amino acid sequence variants and structural derivations that increase the plasma half-life of the peptide, increase the specific activity of the pharmacologic activity, decrease immunogenicity, and decrease the biotransformation of the peptides. The modified cupredoxin derived peptides can be used in methods to treat mammals for cancer, conditions related to inappropriate angiogenesis, viral and bacterial infections, and specifically HIV and malaria, conditions related to ephrin signaling, and to deliver cargo compounds, including diagnostic compounds, to cancer cells.

50 Claims, 3 Drawing Sheets

MODIFICATIONS OF CUPREDOXIN DERIVED PEPTIDES AND METHODS OF USE THEREOF

CROSS REFERENCE TO RELATED APPLICATIONS

This application claims priority under 35 U.S.C. §§ 119 and 120, of Provisional U.S. Application Ser. No. 60/843, 388, filed Sep. 11, 2006. This application is also a continuation-in-part of U.S. patent application Ser. No. 11/244,105, filed Oct. 6, 2005, issued on Apr. 6, 2010 as U.S. Pat. No. 7,691,383, which claims priority to U.S. Provisional Patent Application No. 60/616,782, filed Oct. 7, 2004, U.S. Provisional Patent Application No. 60/680,500, filed May 13, 2005, and U.S. Provisional Patent Application No. 60/700, 297, filed Jul. 19, 2005. The entire contents of those applications are fully incorporated herein by reference.

STATEMENT OF GOVERNMENTAL INTEREST

The subject matter of this application has been supported by a research grant from the National Institutes of Health (NIH), Bethesda, Md., U.S.A., (Grant Number ES 04050-18). The government may have certain rights in this invention.

FIELD OF THE INVENTION

The present invention relates to modified cupredoxin derived peptides with pharmacologic activity that have improved pharmacokinetic properties, and methods to use them to treat mammals suffering from various conditions related to the pharmacologic activities. Modifications of the cupredoxin derived peptides include amino acid sequence variants and structural derivations that may increase the plasma half-life of the peptide, increase the specific activity of the pharmacologic activity, decrease immunogenicity, and/or decrease the biotransformation of the peptides. The modified cupredoxin derived peptides can be used in methods to treat mammals for cancer, conditions related to inappropriate angiogenesis, viral and bacterial infections, and specifically HIV and malaria, conditions related to ephrin signaling and deliver cargo compounds, including diagnostic compounds, to cancer cells.

BACKGROUND

The cupredoxin azurin from *Pseudomonas aeruginosa* is a promising new therapeutic and diagnostic molecule. Two redox proteins elaborated by *P. aeruginosa*, the cupredoxin azurin and cytochrome $c_{551}$ (Cyt $c_{551}$), both enter J774 cells and show significant cytotoxic activity towards the human cancer cells as compared to normal cells. Zaborina et al., Microbiology 146: 2521-2530 (2000). Azurin can also enter human melanoma UISO-Mel-2 or human breast cancer MCF-7 cells. Yamada et al., PNAS 99:14098-14103 (2002); Punj et al., Oncogene 23:2367-2378 (2004); Yamada et al., Cell. Biol. 7:14181431 (2005). In addition, azurin from *P. aeruginosa* preferentially enters J774 murine reticulum cell sarcoma cells, forms a complex with and stabilizes the tumor suppressor protein p53, enhances the intracellular concentration of p53, and induces apoptosis. Yamada et al., Infection and Immunity, 70:7054-7062 (2002). Azurin also caused a significant increase of apoptosis in human osteosarcoma cells as compared to non-cancerous cells. Ye et al., Ai Zheng 24:298-304 (2003). Rusticyanin from *Thiobacillus ferooxidans* can also enter macrophages and induce apoptosis. Yamada et al., Cell Cycle 3:1182-1187 (2004); Yamada et al., Cell. Micro. 7:1418-J431 (2005). Plastocyanin from *Phormidium laminosum* and pseudoazurin form *Achromobacter cycloclastes* also are cytotoxic towards macrophages. U.S. Pat. Pub. No. 20060040269, published Feb. 23, 2006.

Azurin is now also known to have other pharmacologic activities of therapeutic importance. It is known to inhibit angiogenesis in human umbilical vascular endothelium cells (HUVECs). U.S. patent application Ser. No. 11/488,693, filed Jul. 19, 2006. Azurin from *P. aeruginosa* is also known for its ability to inhibit the growth of HIV-1 infection in peripheral blood mononuclear cells and to inhibit parasitemia of malaria-infected mammalian red blood cells. Chaudhari et al., Cell Cycle. 5: 1642-1648 (2006). Azurin from *P. aeruginosa* is also known to interfere with the ephrin signaling system in various mammalian cells and tissues. U.S. patent application Ser. No. 11/436,592, filed May 19, 2006.

Azurin, and in particular, two peptides derived from azurin, an 18-mer and a 28-mer, have therefore been found to be useful therapeutically and diagnostically. However, the efficacy of a therapeutic agent in body of the patient is dependant on several factors. In addition to the activity of the therapeutic drug itself, there are also the pharmacokinetic properties of the therapeutic drug, and how it relates to the various processes that take place after the drug is administered, i.e., absorption, distribution, metabolism and excretion. These pharmacokinetic properties of the drug describe how and to what extent these biological processes influence the efficacy of the administered drug, and these properties include the drug half-life in the blood stream, the hepatic first-pass metabolism of the drug, the volume distribution of the drug, the degree of albumin binding of the drug, etc. Each of these pharmacokinetic properties can have a profound effect on the efficacy of the drug.

The site of absorption of the drug into the bloodstream of the patient depends on the route of administration. For example, orally administered drugs may be absorbed more at one site of the alimentary tract than another site due to the chemical and physical nature of the drug. Absorption by parenteral administration, on the other hand, is not only faster than oral administration, but the blood levels of the drug are far more predictable because much less of the drug is lost, particularly in intravenous administration. The bioavailability is the fraction of the administered drug that reaches the systemic circulation.

The distribution of the drug from the bloodstream into the extracellular fluid (interstitium) and/or cells of the tissues may be altered by various aspects of the drug. The distribution of the drug in the body may be expressed as the "volume distribution of the drug," which is a hypothetical volume of liquid into which the drug is disseminated. The structure of the drug may influence the drug distribution in that hydrophobic drugs more readily move across most biological membranes, and thus may be distributed within cells of the tissues. A drug may also be bound to blood proteins and its passage into surrounding tissues thus delayed. For example, when in the blood stream, naproxen is 99% bound to plasma proteins, penicillin G is 60% bound, amoxicillin only 20% bound and minoxidil is unbound. Howard C. Ansel et al., *Pharmaceutical Dosage Forms and Delivery Systems* 129 (Lippincott. Williams and Wilkins 1999). A bound drug is neither exposed to the body's detoxification processes, not is it removed from the bloodstream by filtration through the renal glomeruli. The bound drug is referred to as the inactive portion while the unbound portion is considered the active portion. The bound portion of the drug serves as a reservoir of the drug that is then released into the bloodstream in an unbound active form when the level of free drug is not longer sufficient to ensure protein saturation. Therefore, a drug that is bound in the bloodstream will remain in the body for longer periods of time and will require a less frequent dosage.

The metabolism of the drug in the patient will also affect its efficacy. Many drugs undergo biotransformation before being excreted from the body. The biotransformation of a drug may result in a form of the drug that is more water soluble, ore ionized, less capable of binding proteins in the plasma and tissues, less able to penetrate cell membranes, and other aspects that make the drugs less pharmacologically active. The biotransformed drug may therefore be rendered less toxic and more readily excreted. There are four major ways by which drugs are biotransformed: oxidation, reduction, hydrolysis, and conjugation. Oxidation reactions are primarily catalyzed by oxidases bound to the endoplasmic reticulum within the liver cells. Reduction reactions are catalyzed by reductases primarily in the gut and liver. Hydrolytic breakdown is catalyzed by esterases primarily in the liver. Glucuronide conjugation, the most common pathway of biotransformation of a drug, occurs by a combination of the drug with glucuronic acid, forming an ionic form of the drug that is easily eliminated from the body. Christensen et al., J. Pharm. Pharmacol. 37:91-95 (1985). Other biotransformative processes that increase elimination include methylation and acylation.

Excretion of the drug from the body may occur by various routes. The kidney plays the dominate role of eliminating the drug in the urine. However, the drug can also be eliminated from the plasma through the liver. With drugs that are orally administered in particular, the liver may play an important role in determining the plasma half-life of the drug.

What is needed are cupredoxin derived peptides that have the pharmacologic activities of the cupredoxins, and have improved pharmacokinetic properties in mammals. In particular, cupredoxin derived peptides that are stable in the body of the patient and maintain a high specific pharmacologic activity, as well as have a long plasma half-life will be particularly effective therapeutic and diagnostic agents.

SUMMARY OF THE INVENTION

On aspect of the invention provides an isolated modified cupredoxin derived peptide that is a variant or derivative of a cupredoxin derived peptide. In embodiment, the isolated modified cupredoxin derived peptide has improved pharmacokinetic properties as compared to the unmodified cupredoxin derived peptide. The improved pharmacokinetic property may be one or more of the peptide (1) is less susceptible to biotransformation in the patient, (2) is excreted from the body of the patient at a slower rate, (3) has increased stability of its tertiary structure and (4) has longer plasma half-life.

Additionally, the isolated peptide may have at least one pharmacologic activity of a cupredoxin. Specific pharmacologic activities of interest include (1) entering a mammalian cancer cell, (2) not entering non-cancerous mammalian cells, (3) entering pre-malignant mammalian cells, (4) killing mammalian cancer cells, (5) killing pre-malignant mammalian cells, (6) inhibiting the growth of a mammalian cancer cell, (7) inhibiting HIV-1 infection, (8) inhibiting parasitemia of malaria-infected red blood cells, (9) interfering with ephrin signaling system and (10) inhibiting angiogenesis.

The modified cupredoxin derived peptide may be derived from a cupredoxin from *Pseudomonas aeruginosa, Phormidium laminosum, Ulva pertussis, Thiobacillus ferrooxidans, Achromobacter cycloclastes, Pseudomonas syringa, Neisseria meningitidis, Vibrio parahaemolyticus, Bordetella bronchiseptica, Bordetella pertussis, Chloroflexus aurantiacus* and *Neisseria gonorrhoeae*. The cupredoxin may be azurin, plastocyanin, rusticyanin, pseudoazurin, auracyanin stellacyanin, cucumber basic protein or azurin-like protein. In specific embodiments, the cupredoxin may be one of SEQ ID NOS: 1-12.

The isolated modified cupredoxin derived peptide may be a truncation of the cupredoxin. In specific embodiments, the peptide may be one of SEQ ID NOS: 13-47. On other specific embodiments, SEQ ID NOS: 1-12 are at least about 90% identical to the isolated peptide.

In some embodiments, the isolated modified cupredoxin derived peptide may be less susceptible to hydrolysis. Specifically, the isolated peptide may have one or more asparagine or serine residues in the sequence of the cupredoxin derived peptide are replaced with another amino acid residue, specifically a glutamic acid or threonine residue.

In some embodiments, the isolated modified cupredoxin derived peptide is less susceptible to deamidation. In specific embodiments, one or more glycine residues of the cupredoxin derived peptide are replaced with another amino acid residue, specifically a threonine or alanine residue. In some embodiments, one or more of the glycine residues in the cupredoxin derived peptide that are equivalent to residues 58 or 63 of *Pseudomonas aeruginosa* azurin (SEQ ID NO: 1) may be replaced. In another specific embodiment, the isolated peptide may comprise SEQ ID NO: 30.

In some embodiments, the isolated modified cupredoxin derived peptide is less susceptible to oxidation. Specifically, the isolated peptide may have one or more methionine or cysteine residues of the cupredoxin derived peptide replaced with another amino acid residue, specifically a leucine or valine residue. In a specific embodiment, one or more methionine residues of the cupredoxin derived peptide that are equivalent to residues 56 or 64 of *Pseudomonas aeruginosa* azurin (SEQ ID NO: 1) is replaced. In another specific embodiment, the isolated peptide may comprise SEQ ID NO: 31 or SEQ ID NO: 32.

In some embodiments, the isolated modified cupredoxin derived peptide may be less susceptible to diketopiperazine and pyroglutamic acid formation. Specifically, the isolated peptide may have a glycine residue in positions 1, 2 or 3 from the N-terminus of the cupredoxin derived peptide replaced with another amino acid residue. Further, the isolated peptide may have a proline residue in position 3 from the N-terminus of the cupredoxin derived peptide is replaced with another amino acid residue. Further, the isolated peptide may have an asparagine residue at the N-terminus of the cupredoxin derived peptide replaced with another amino acid residue.

In some embodiments, the isolated modified cupredoxin derived peptide may be less susceptible to racemization. Specifically, the isolated peptide may have one or more amino acid residues of the cupredoxin derived peptide replaced with the D-isomer of the amino acid residue. In one specific embodiment, all of the amino acid residues of the cupredoxin derived peptide are replaced with the D-isomers of the amino acid residues. In another specific embodiment, the isolated peptide comprises SEQ ID NO: 45.

In some embodiments, the isolated modified cupredoxin derived peptide may be less susceptible to degradation. Specifically, the N-terminus of the cupredoxin derived peptide may be acetylated. Further, the C-terminus of the cupredoxin derived peptide may be amidated. In one specific embodiment, the isolated peptide is SEQ ID NO: 33.

In some embodiments, the isolated modified cupredoxin derived peptide is modified to increase the stability of its tertiary structure. Specifically, the isolated peptide may be modified to increase the stability of a least one α-helix. In some embodiments, at least one glycine, proline, serine, aspartic acid, alanine, threonine, valine, glutamine, asparagine, cysteine, histidine, lysine, and arginine amino acid residue of the cupredoxin derived peptide is replaced with leucine, isoleucine, phenylalanine, glutamic acid, tyrosine, tryptophan or methionine. In a specific embodiment, the replaced residue of the cupredoxin derived peptide may be within equivalent residues to residues 53-56, 58-64 and 68-70 of P. aeruginosa azurin. In other specific embodiments, the glutamine at a residue equivalent to residue 57 of P. aeruginosa azurin may be replaced with a tryptophan residue, the threonine at a residue equivalent to residue 52 of P. aeruginosa azurin may be replaced with a tryptophan residue, the threonine at a residue equivalent to residue 61 of P. aeruginosa azurin may be replaced with a tryptophan residue, and/or the glycine at a residue equivalent to residue 63 of P. aeruginosa azurin is replaced with a tryptophan residue. In other specific embodiments, the isolated peptide comprises one of SEQ ID NOS: 34-44.

In other embodiments, the isolated peptide may have two or more lysine residues of the cupredoxin derived peptide substituted with ε-(3,5-dinitrobenzoyl)-lysine residues in an i(i+4) spacing. Specifically, the replaced residues of the cupredoxin derived peptide may be within residues equivalent to residues 53-56, 58-64 and 68-70 of P. aeruginosa azurin.

In other embodiments, the isolated peptide may have histidine-cysteine or histidine-histidine residue pairs substituted into the cupredoxin derived peptide at an i(i+4) spacing, and at least one of Cu, Zn, Cd and Ru. In a specific embodiment, the isolated peptide may have the replaced residues of the cupredoxin derived peptide within residues equivalent to residues 53-56, 58-64 and 68-70 of P. aeruginosa azurin.

In another embodiment, the isolated peptide may have one or more pairs of native amino acid residues in the cupredoxin derived peptide substituted with α,α-disubstituted non-natural amino acids with olefin-bearing tethers that correspond to the native amino acids. The isolated peptide may have the replaced residues of the cupredoxin derived peptide within residues equivalent to residues 53-56, 58-64 and 68-70 of P. aeruginosa azurin.

In some embodiments, the isolated modified cupredoxin derived peptide may have one or more PEG (polyethylene glycol) molecules covalently bonded to the cupredoxin derived peptide. Specifically, the isolated peptide may have one or more PEG molecules is covalently bonded to one or more cysteine residues of the cupredoxin derived peptide. In specific embodiments, the isolated peptide may have one or more PEG molecules are covalently bonded to one or more cysteine residues equivalent to one or more of residues 3, 6, and 112 of Pseudomonas aeruginosa azurin (SEQ ID NO: 1). In another embodiment, a cysteine residue may be substituted into the cupredoxin derived peptide and may be covalently bonded to a PEG molecule.

In another embodiment, the isolated peptide may have one or more PEG molecules covalently bonded to the cupredoxin derived peptide at a lysine, cysteine, histidine, arginine, aspartic acid, glutamic acid, serine, threonine, tyrosine, N-terminal amino group, or C-terminal carboxylic acid. In specific embodiments, the isolated peptide has one or more lysine residues or C-terminal carboxylic acids covalently bonded to a PEG molecule. In another embodiment, one or more lysine, cysteine, histidine, arginine, aspartic acid, glutamic acid, serine, threonine and tyrosine residues may be substituted into the cupredoxin derived peptide and may be covalently bonded to a PEG molecule.

In other embodiments, one or more PEG molecules may be covalently bonded to one or more amino groups of the cupredoxin derived peptide, or randomly covalently bonded to the cupredoxin derived peptide.

The average molecular weight of the PEG molecules per cupredoxin derived peptide may be about 200 to about 100,000 daltons. The cupredoxin derived peptide may be covalently bonded to one or more branched PEG molecules, specifically where the branched PEG molecule is about 50 kDa. The cupredoxin derived peptide may be covalently bonded to one or more linear PEG molecules, specifically where the linear PEG molecule is about 5 kDa.

Another aspect of the invention is a pharmaceutical composition which may comprise a modified cupredoxin derived peptide and a pharmaceutically acceptable carrier.

Another aspect of the invention is a method to treat conditions suffered by mammals which may comprise administering to the mammal a therapeutically effective amount of the modified cupredoxin derived peptides. In specific embodiments, the mammal is human.

Another aspect of the invention is an isolated peptide which comprises, or alternatively consists of, the amino acid sequence $X_1SX_2AADX_3X_4X_5VVX_6DX_7X_8ASGLDKDYLKPDX_9$ (SEQ ID NO:48); wherein $X_1$ is selected from the group consisting of L and acetylated-L; $X_2$ is selected from the group consisting of T and W; $X_3$ is selected from the group consisting of M, L and V; $X_4$ is selected from the group consisting of Q and W; $X_5$ is selected from the group consisting of G and A; $X_6$ is selected from the group consisting of T and W; $X_7$ is selected from the group consisting of G, T and W; $X_8$ is selected from the group consisting of M, L and V; and $X_9$ is selected from the group consisting of D and amidated-D.

Another aspect of the invention is an isolated peptide comprising, or alternatively consisting of, the amino acid sequence $X_1DPKLYDKDLGSAX_2X_3DX_4VVX_5X_6X_7DAAX_8SX_9$ (SEQ ID NO:49); wherein $X_1$ is selected from the group consisting of D and acetylated-D; $X_2$ is selected from the group consisting of M, L and V; $X_3$ is selected from the group consisting of G, T and W; $X_4$ is selected from the group consisting of T and W; $X_5$ is selected from the group consisting of G and A; $X_6$ is selected from the group consisting of Q and W; $X_7$ is selected from the group consisting of M, L and V; $X_8$ is selected from the group consisting of T and W; and $X_9$ is selected from the group consisting of L and amidated-L.

Another aspect of the invention is an isolated peptide comprising, or consisting of, the sequences of SEQ ID NOS: 50-3506.

BRIEF DESCRIPTION OF THE SEQUENCES

SEQ ID NO: 1 is the amino acid sequence of wt-azurin from *Pseudomonas aeruginosa*.

SEQ ID NO: 2 is the amino acid sequence of plastocyanin from *Phormidium laminosum*.

SEQ ID NO: 3 is the amino acid sequence of rusticyanin from *Thiobacillus ferrooxidans*.

SEQ ID NO: 4 is the amino acid sequence of pseudoazurin from *Achromobacter cycloclastes*.

SEQ ID NO: 5 is the amino acid sequence of azurin from *Pseudomonas syringae*.

SEQ ID NO: 6 is the amino acid sequence of Laz from *Neisseria gonorrhoeae*.

SEQ ID NO: 7 is the amino acid sequence of the Laz from *Neisseria meningitides*.

SEQ ID NO: 8 is the amino acid sequence of the azurin from *Vibrio parahaemolyticus*.

SEQ ID NO: 9 is the amino acid sequence of the azurin from *Bordetella bronchiseptica*.

SEQ ID NO: 10 is the amino acid sequence of the auracyanin A from *Chloroflexus aurantiacus*

SEQ ID NO: 11 is the amino acid sequence of the auracyanin B from *Chloroflexus aurantiacus*.

SEQ ID NO: 12 is the amino acid sequence of the azurin from *Bordetella pertussis*.

SEQ ID NO: 13 is the amino acid sequence of the 50-77 amino acid fragment of wt-azurin from *Pseudomonas aeruginosa*.

SEQ ID NO: 14 is the amino acid sequence of the 50-67 amino acid fragment of wt-azurin from *Pseudomonas aeruginosa*.

SEQ ID NO: 15 is the amino acid sequence of the 36-128 amino acid fragment of wt-azurin from *Pseudomonas aeruginosa*.

SEQ ID NO: 16 is the amino acid sequence of the 36-89 amino acid fragment of wt-azurin from *Pseudomonas aeruginosa*.

SEQ ID NO: 17 is the amino acid sequence of the 36-77 amino acid fragment of wt-azurin from *Pseudomonas aeruginosa*.

SEQ ID NO: 18 is the amino acid sequence of the 36-50 amino acid fragment of wt-azurin from *Pseudomonas aeruginosa*.

SEQ ID NO: 19 is the amino acid sequence of the 50-66 amino acid fragment of wt-azurin from *Pseudomonas aeruginosa*.

SEQ ID NO: 20 is the amino acid sequence of the 67-77 amino acid fragment of wt-azurin from *Pseudomonas aeruginosa*.

SEQ ID NO: 21 is the amino acid sequence of the 57-89 amino acid fragment of auracyanin B of *Chloroflexus aurantiacus*.

SEQ ID NO: 22 is the amino acid sequence of the 50-77 amino acid fragment of azurin from *Bordetella pertussis*.

SEQ ID NO: 23 is the amino acid sequence of the 89-115 amino acid fragment of the Laz protein from *Neisseria meningitidis*.

SEQ ID NO: 24 is the amino acid sequence of the 53-70 amino acid fragment of azurin from *Pseudomonas aeruginosa*.

SEQ ID NO: 25 is the amino acid sequence of the 53-64 amino acid fragment of azurin from *Pseudomonas aeruginosa*.

SEQ ID NO: 26 is the amino acid sequence of the 51-77 amino acid fragment from azurin from *Pseudomonas aeruginosa*.

SEQ ID NO: 27 is the amino acid sequence of the 51-77 amino acid fragment from azurin from *Pseudomonas syringae*.

SEQ ID NO: 28 is the amino acid sequence of the is the 52-78 amino acid fragment from azurin from *Vibrio parahaemolyticus*.

SEQ ID NO: 29 is the amino acid sequence of the 51-77 amino acid fragment from azurin from *Bordetella bronchiseptica*.

SEQ ID NO: 30 is an artificial sequence for a variant form of the 50-77 amino acid region of *Pseudomonas aeruginosa* azurin.

SEQ ID NO: 31 is an artificial sequence for a variant form of the 50-77 amino acid region of *Pseudomonas aeruginosa* azurin.

SEQ ID NO: 32 is an artificial sequence for a variant form of the 50-77 amino acid region of *Pseudomonas aeruginosa* azurin.

SEQ ID NO: 33 is an artificial sequence for a variant form of the 50-77 amino acid region of *Pseudomonas aeruginosa* azurin.

SEQ ID NO: 34 is an artificial sequence for a variant form of the 50-77 amino acid region of *Pseudomonas aeruginosa* azurin.

SEQ ID NO: 35 is an artificial sequence for a variant form of the 50-77 amino acid region of *Pseudomonas aeruginosa* azurin.

SEQ ID NO: 36 is an artificial sequence for a variant form of the 50-77 amino acid region of *Pseudomonas aeruginosa* azurin.

SEQ ID NO: 37 is an artificial sequence for a variant form of the 50-77 amino acid region of *Pseudomonas aeruginosa* azurin.

SEQ ID NO: 38 is an artificial sequence for a variant form of the 50-77 amino acid region of *Pseudomonas aeruginosa* azurin.

SEQ ID NO: 39 is an artificial sequence for a variant form of the 50-77 amino acid region of *Pseudomonas aeruginosa* azurin.

SEQ ID NO: 40 is an artificial sequence for a variant form of the 50-77 amino acid region of *Pseudomonas aeruginosa* azurin.

SEQ ID NO: 41 is an artificial sequence for a variant form of the 50-77 amino acid region of *Pseudomonas aeruginosa* azurin.

SEQ ID NO: 42 is an artificial sequence for a variant form of the 50-77 amino acid region of *Pseudomonas aeruginosa* azurin.

SEQ ID NO: 43 is an artificial sequence for a variant form of the 50-77 amino acid region of *Pseudomonas aeruginosa* azurin.

SEQ ID NO: 44 is an artificial sequence for a variant form of the 50-77 amino acid region of *Pseudomonas aeruginosa* azurin.

SEQ ID NO: 45 is an artificial sequence for a variant form of the 50-77 amino acid region of *Pseudomonas aeruginosa* azurin.

SEQ ID NO: 46 is a conserved amino acid sequence from azurins where D is aspartic acid, G is glycine, Y is tyrosine, K is lysine and X is any amino acid.

SEQ ID NO: 47 is a conserved amino acid sequence from azurins where D is aspartic acid, G is glycine, Y is tyrosine, K is lysine and X is any amino acid.

SEQ ID NO: 48 is an artificial sequence of modifications to azurin 50-77 of *Pseudomonas aeruginosa*.

SEQ ID NO: 49 is an artificial sequence of modifications to the D-isomer of azurin 50-77 of *Pseudomonas aeruginosa*.

SEQ ID NO: 50-3506 are artificial sequences of modified cupredoxin derived peptides.

DETAILED DESCRIPTION OF THE EMBODIMENTS

Definitions

Figure 1:
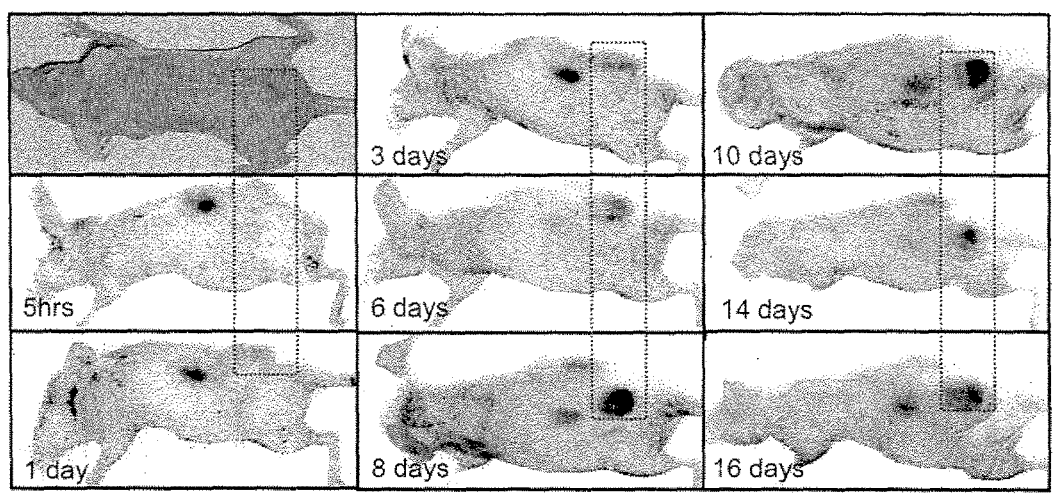
FIG. 1 depicts the images of whole mouse scans of mice that have been injected with labeled p18. IRDye® labeled p18 (125 µg) was injected intravenously and athymic mice were scanned at indicated time periods for detection of labeled dye in tumors and organs using the Odyssey® Infrared Imaging System.

As used herein, the term "cell" includes both the singular or the plural of the term, unless specifically described as a "single cell."

As used herein, the terms "polypeptide," "peptide," and "protein" are used interchangeably to refer to a polymer of amino acid residues. The terms apply to amino acid polymers in which one or more amino acid residues are an artificial chemical analogue of a corresponding naturally occurring amino acid. The terms also apply to naturally occurring amino acid polymers. The terms "polypeptide," "peptide," and "protein" are also inclusive of modifications including, but not limited to, glycosylation, lipid attachment, sulfation, gamma-carboxylation of glutamic acid residues, hydroxylation and ADP-ribosylation. It will be appreciated that polypeptides are not always entirely linear. For instance, polypeptides may be branched as a result of ubiquitination and they may be circular (with or without branching), generally as a result of post-translation events, including natural processing event and events brought about by human manipulation which do not occur naturally. Circular, branched and branched circular polypeptides may be synthesized by non-translation natural process and by entirely synthetic methods as well. A synthetic peptide is one made without the aid of cellular components. Synthetic methods to make peptides are well known in the art and are commercially available. Further, this invention contemplates the use of both the methionine-containing and the methionine-less amino terminal variants of the protein of the invention.

As used herein, the term "condition" includes anatomic and physiological deviations from the normal that constitute an impairment of the normal state of the living animal or one of its parts, that interrupts or modifies the performance of the bodily functions.

As used herein, the term "inhibit cell growth" means the slowing or ceasing of cell division and/or cell expansion. This term also includes the inhibition of cell development or increases in cell death.

As used herein, the term "suffering from" includes presently exhibiting the symptoms of a condition, having a condition even without observable symptoms, in recovery from a condition, and recovered from a condition.

A used herein, the term "treatment" includes preventing, lowering, stopping, or reversing the progression or severity of the condition or symptoms associated with a condition being treated. As such, the term "treatment" includes medical, therapeutic, and/or prophylactic administration, as appropriate.

A "therapeutically effective amount" is an amount effective to prevent, lower, stop or reverse the development of, or to partially or totally alleviate a particular condition, or the existing symptoms of a particular condition for which the subject being treated. Determination of a therapeutically effective amount is well within the capability of those skilled in the art.

As used herein, the term "pharmacologic activity" means the effect of a drug or other chemical on a biological system. The effect of chemical may be beneficial (therapeutic) or harmful (toxic). The pure chemicals or mixtures may be of natural origin (plant, animal, or mineral) or may be synthetic compounds.

As used herein, the term "premalignant" means precancerous, or before abnormal cells divide without control.

As used herein, the term "pharmacokinetic property" refers to a parameter that describes the disposition of an active agent or drug in an organism or host. Representative pharmacokinetic properties include: plasma half-life, hepatic first-pass metabolism, volume of distribution, degree of blood serum protein, e.g. albumin, binding, etc.

As used herein, the term "plasma half-life" refers to the time for one-half of an administered drug to be eliminated from the plasma of the patient through biological processes, e.g., biometabolism, excretion, etc.

As used herein, the term "volume of distribution" refers to the distribution and degree of retention of a drug throughout the various compartments of an organisms, e.g. intracellular and extracellular spaces, tissues and organs, etc. This factor is expressed as the "apparent volume of distribution," or $V_d$, which is the estimated volume of the body into which the drug has distributed. A large Vd suggests that the drug has distributed more broadly throughout the body and may be associated with the longer half-life because a lesser portion of the drug will be in the plasma and thus delivered to the elimination points, the kidney and the liver.

As used herein, the term "degree of blood serum binding" refers to the propensity of a drug to be bound by a blood serum protein, such as albumin.

As used herein, the term "efficacy" refers to the effectiveness of a particular active agent for its intended purpose, i.e. the ability of a given active agent to cause its desired pharmacologic effect.

As used herein, the term "specific activity" refers to the amount of product formed by an enzyme in a given amount of time under given conditions per milligram of enzyme. Specific activity is equal to the rate of reaction multiplied by the volume of reaction divided by the mass of enzyme. In the case of a transport peptide, the specific activity will be the amount of transport peptide or transport peptide-cargo complex internalized into a cell in a given amount of time under given conditions per milligram of transport peptide or transport peptide-cargo complex.

The term "substantially pure," as used herein, when used to modify a protein or other cellular product of the invention, refers to, for example, a protein isolated from the growth medium or cellular contents, in a form substantially free of, or unadulterated by, other proteins and/or active inhibitory compounds. The term "substantially pure" refers to a factor in an amount of at least about 75%, by dry weight, of isolated fraction, or at least "75% substantially pure." More specifically, the term "substantially pure" refers to a compound of at least about 85%, by dry weight, active compound, or at least "85% substantially pure." Most specifically, the term "substantially pure" refers to a compound of at least about 95%, by dry weight, active compound, or at least "95% substantially pure." The term "substantially pure" may also be used to modify a synthetically made protein or compound, where, for example, the synthetic protein is isolated from the reagents and by-products of the synthesis reaction(s).

The term "pharmaceutical grade," as used herein, when referring to a peptide or compound of the invention, is a peptide or compound that is isolated substantially or essentially from components which normally accompany the material as it is found in its natural state, including synthesis reagents and by-products, and substantially or essentially isolated from components that would impair its use as a pharmaceutical. For example, a "pharmaceutical grade" peptide may be a isolated away from any carcinogen. In some instances, "pharmaceutical grade" may be modified by the intended method of administration, such as "intravenous pharmaceutical grade," in order to specify a peptide or compound that is substantially or essentially isolated from any substance that would render the composition unsuitable for intravenous administration to a patient. For example, an "intravenous pharmaceutical grade" peptide may be isolated from detergents, such as SDS, and anti-bacterial agents, such as azide.

The phrases "isolated," "purified" or "biologically pure" refer to material which is substantially or essentially free from components which normally accompany the material as it is found in its native state. Thus, isolated peptides in accordance with the invention preferably do not contain materials normally associated with the peptides in their in situ environment. An "isolated" region refers to a region that does not include the whole sequence of the polypeptide from which the region was derived. An "isolated" nucleic acid, protein, or respective fragment thereof has been substantially removed from its in vivo environment so that it may be manipulated by the skilled artisan, such as but not limited to nucleotide sequencing, restriction digestion, site-directed mutagenesis, and subcloning into expression vectors for a nucleic acid fragment as well as obtaining the protein or protein fragment in substantially pure quantities.

The term "wild-type," as used herein to refer to a peptide, mean that the peptide has the same sequence as one naturally occurring.

The term "variant" as used herein with respect to a peptide, refers to amino acid sequence variants that may have amino acids replaced, deleted, or inserted as compared to the wild-type polypeptide. Variants may be truncations of the wild-type peptide. A "deletion" is the removal of one or more amino acids from within the wild-type protein, while a "truncation" is the removal of one or more amino acids from one or more ends of the wild-type protein. Thus, a variant peptide may be made by manipulation of genes encoding the polypeptide. A variant may be made by altering the basic composition or characteristics of the polypeptide, but not at least some of its fundamental pharmacologic activities. For example, a "variant" of the *Pseudomonas aeruginosa* transit peptide may be a mutated *Pseudomonas aeruginosa* transit peptide that retains its ability to enter cancer cells. In some cases, a variant peptide is synthesized with non-natural amino acids, such as ε-(3,5-dinitrobenzoyl)-Lys residues. (Ghadiri & Fernholz, J. Am. Chem. Soc., 112:9633-9635 (1990)). In some embodiments, the variant has not more than 20, 19, 18, 17 or 16 amino acids replaced, deleted or inserted compared to wild-type peptide or a portion thereof. In some embodiments, the variant has not more than 15, 14, 13, 12 or 11 amino acids replaced, deleted or inserted compared to wild-type peptide or a portion thereof. In some embodiments, the variant has not more than 10, 9, 8 or 7 amino acids replaced, deleted or inserted compared to wild-type peptide or a portion thereof. In some embodiments, the variant has not more than 6 amino acids replaced, deleted or inserted compared to wild-type peptide or a portion thereof. In some embodiments, the variant has not more than 5 or 4 amino acids replaced, deleted or inserted compared to wild-type peptide or a portion thereof. In some embodiments, the variant has not more than 3, 2 or 1 amino acids replaced, deleted or inserted compared to wild-type peptide or a portion thereof.

The term "amino acid," as used herein, means an amino acid moiety that comprises any naturally-occurring or non-naturally occurring or synthetic amino acid residue, i.e., any moiety comprising at least one carboxyl and at least one amino residue directly linked by one, two, three or more carbon atoms, typically one (a) carbon atom. An amino acid may be an L-isomer or a D-isomer of an amino acid.

The term "derivative" as used herein with respect to a peptide refers to a peptide that is derived from the subject peptide. A derivation includes chemical modifications of the peptide such that the peptide still retains some of its fundamental pharmacologic activities. For example, a "derivative" of a *Pseudomonas aeruginosa* transport peptide can be a chemically modified *Pseudomonas aeruginosa* transport peptide that retains its ability to enter cancer cells. Chemical modifications of interest include, but are not limited to, amidation, acetylation, sulfation, polyethylene glycol (PEG) modification, phosphorylation or glycosylation of the peptide. In addition, a derivative peptide maybe a fusion of a polypeptide to a chemical compound, such as, but not limited to, another peptide, drug molecule or other therapeutic or pharmaceutical agent or a detectable probe.

The term "percent (%) amino acid sequence identity" is defined as the percentage of amino acid residues in a polypeptide that are identical with amino acid residues in a candidate sequence when the two sequences are aligned. To determine % amino acid identity, sequences are aligned and if necessary, gaps are introduced to achieve the maximum % sequence identity; conservative substitutions are not considered as part of the sequence identity. Amino acid sequence alignment procedures to determine percent identity are well known to those of skill in the art. Often publicly available computer software such as BLAST, BLAST2, ALIGN2 or Megalign (DNASTAR) software is used to align peptide sequences. In a specific embodiment, Blastp (available from the National Center for Biotechnology Information, Bethesda Md.) is used using the default parameters of long complexity filter, expect 10, word size 3, existence 11 and extension 1.

When amino acid sequences are aligned, the % amino acid sequence identity of a given amino acid sequence A to, with, or against a given amino acid sequence B (which can alternatively be phrased as a given amino acid sequence A that has or comprises a certain % amino acid sequence identity to, with, or against a given amino acid sequence 13) can be calculated as:

$$\text{\% amino acid sequence identity} = X/Y*100$$

where
X is the number of amino acid residues scored as identical matches by the sequence alignment program's or algorithm's alignment of A and B and
Y is the total number of amino acid residues in B.

If the length of amino acid sequence A is not equal to the length of amino acid sequence B, the % amino acid sequence identity of A to B will not equal the % amino acid sequence identity of B to A. When comparing longer sequences to shorter sequences, the shorter sequence will be the "B" sequence. For example, when comparing truncated peptides to the corresponding wild-type polypeptide, the truncated peptide will be the "B" sequence.

General

The present invention relates cupredoxin derived peptides that maintain one or more pharmacologic activities of the cupredoxin and which may have improved pharmacokinetic properties, such as improved stability, specific activity, half-life in the bloodstream, and/or decreased immunogenicity, among others. Additionally, the present invention relates to compounds derived from the modified cupredoxin derived peptides, which in turn also maintain one or more pharmacologic vines of the cupredoxin and which have improved pharmacokinetic properties. Finally, the invention relates to methods to use the modified cupredoxin derived peptides and compound made from them to treat and/or diagnose various conditions suffered by mammalian patients, and to research various conditions suffered by mammalian patients.

Compositions

The invention relates to peptides that are modifications of cupredoxin derived peptides which have improved pharmacokinetic properties. In some embodiments, these modified cupredoxin derived peptides retain at least one pharmacologic activity of the cupredoxin. In some embodiments, the modified cupredoxin derived peptides are isolated, substantially pure, or pharmaceutical grade. In specific embodiments, the modified cupredoxin derived peptides are intravenous pharmaceutical grade.

Cupredoxins, and specifically azurin from *Pseudomonas aeruginosa*, are known to have several useful pharmacologic activities that are useful for treating and/or diagnosing mammalian patients, and for conducting research on conditions suffered by mammalian patients. For example, many cupredoxin proteins, such as *Pseudomonas aeruginosa* azurin, have the ability to specifically enter and kill many types of mammalian cancer cells. Yamada et al., Cell. Biol. 7:1418-1431 (2005); Hiraoka et al., PNAS 101:6427-6432 (2004); Hiraoka et al., Biochem. Biophys. Res. Comm. 338:1284-1290 (2005); U.S. patent application Ser. No. 11/244,105, filed Oct. 6, 2005; U.S. patent application Ser. No. 10/720,603, filed Nov. 24, 2003; U.S. patent application Ser. No. 10/047,710, filed Jan. 15, 2002; U.S. patent application Ser. No. 11/485,252, filed Jul. 13, 2006, all of which are expressly incorporated herein by reference in their entirety. Azurin from *P. aeruginosa* is also known to inhibit the growth of viral or bacterial infection, and more specifically HIV-1 infection in peripheral blood mononuclear cells and also to inhibit parasitemia of malaria-infected mammalian red blood cells. Chaudhari et al., Cell Cycle. 5:1642-1648 (2006); U.S. patent application Ser. No. 11/436,591, filed May 19, 2006; U.S. patent application Ser. No. 11/436,590, filed May 19, 2006, both of which are expressly incorporated herein by reference in their entirety. Azurin from *P. aeruginosa* is also known to interfere with the ephrin signaling system in various mammalian cells and tissues. U.S. patent application Ser. No. 11/436,592, filed May 19, 2006, which is expressly incorporated herein by reference in its entirety. Further, peptides derived from *P. aeruginosa* azurin are known to inhibit angiogenesis in mammalian cells, and specifically human umbilical vascular endothelium cells (HUVECs). U.S. patent application Ser. No. 11/488,693, filed Jul. 19, 2006, which is expressly incorporated herein by reference in its entirety. In some embodiments, the modified cupredoxin derived peptides of the invention retain at least one pharmacologic activity of the cupredoxin from which they are derived. The pharmacologic activity of cupredoxin may be any useful activity of a cupredoxin. Pharmacologic activities of particular interest include, but are not limited to, the ability to specifically enter mammalian cancer cells, the inability to enter non-cancerous mammalian cells, the ability to enter pre-malignant mammalian cells, the ability to kill mammalian cancer cells, the ability to kill pre-malignant mammalian cells, the ability to inhibit the growth of viral or bacterial infection, the ability to inhibit the HIV-1 infection in peripheral blood mononuclear cells, the ability to inhibit parasitemia by malaria in malaria-infected red blood cells, and the ability to inhibit angiogenesis in mammalian cells, and specifically HUVECs. Methods to measure the amount of pharmacologic activity of the peptide are provided in the above referenced applications and publications.

The cupredoxin derived peptides may be any cupredoxin, or variant, derivative or structural equivalent of cupredoxin. In some embodiments, the cupredoxin derived peptide retains at least one pharmacologic activity of the cupredoxin. In some embodiments, the cupredoxin may be, but is not limited to, azurin, plastocyanin, rusticyanin, pseudoazurin, auracyanin or azurin-like protein. The cupredoxin derived peptides may be from any organism, including but not limited to *Pseudomonas aeruginosa*, *Phormidium laminosum*, *Thiobacillus ferrooxidans*, *Achromobacter cycloclastes*, *Pseudomonas syringa*, *Neisseria meningitidis*, *Vibrio parahaemolyticus*, *Bordetella bronchiseptica*, *Bordetella pertussis*, *Chloroflexus aurantiacus* and *Neisseria gonorrhoeae*. In some embodiments, the cupredoxin may be azurin, specifically from an organism including but not limited to *Pseudomonas aeruginosa*, *Pseudomonas syringae*, *Neisseria gonorrhoeae*, *Vibrio parahaemolyticus*, or *Bordetella bronchiseptica*.

The cupredoxin derived peptides may be any variant, derivative or structural equivalent of a cupredoxin. The cupredoxin derived peptides may also be any cupredoxin peptide that is known in the art and/or described in previous applications, such as U.S. patent application Ser. No. 11/244,105, filed Oct. 6, 2005; U.S. patent application Ser. No. 10/720,603, filed Nov. 24, 2003; U.S. patent application Ser. No. 10/047,710, filed Jan. 15, 2002; U.S. patent application Ser. No. 11/485,252, filed Jul. 13, 2006; U.S. patent application Ser. No. 11/436,591, filed May 19, 2006; U.S. patent application Ser. No. 11/436,590, filed May 19, 2006; U.S. patent application Ser. No. 11/436,592, filed May 19, 2006; and U.S. patent application Ser. No. 11/488,693, filed Jul. 19, 2006. All of these applications are expressly incorporated by reference herein in their entirety. In some embodiments, the peptide is isolated. In some embodiments, the peptide is substantially pure or pharmaceutical grade. In other embodiments, the peptide is in a composition that comprises, or consists essentially of, the peptide. In another specific embodiment, the peptide does not raise an immune response in a mammal, and more specifically a human.

The cupredoxin derived peptides may be amino acid sequence variants which have amino acids replaced, deleted, or inserted as compared to the wild-type cupredoxin. These variants may be truncations of the wild-type cupredoxin. The cupredoxin derived peptides comprise a region of a cupredoxin that is less that the full length wild-type polypeptide. In some embodiments, the cupredoxin derived peptides comprise more than about 10 residues, more than about 15 residues or more than about 20 residues of a truncated cupredoxin. In some embodiments, the cupredoxin derived peptides comprise not more than about 100 residues, not more than about 50 residues, not more than about 40 residues, not more than about 30 residues or not more than about 20 residues of a truncated cupredoxin. In some embodiments, a cupredoxin has to the cupredoxin derived peptide, and more specifically SEQ. ID NOS: 1-12 at least about 70% amino acid sequence identity, at least about 80% amino acid sequence identity, at least about 90% amino acid sequence identity, at least about 95% amino acid sequence identity or at least about 99% amino acid sequence identity.

In specific embodiments, the cupredoxin derived peptide comprises *P. aeruginosa* azurin residues 50-77, azurin residues 50-67, or azurin residues 36-88. In other embodiments, the variant of cupredoxin consists of *P. aeruginosa* azurin residues 50-77, azurin residues 50-67, or azurin residues 36-88. In other specific embodiments, the variant consists of the equivalent residues of a cupredoxin other that azurin. To determine the equivalent residues of another cupredoxin, the subject cupredoxin amino acid sequence will be aligned to the *Pseudomonas aeruginosa* azurin sequence using BLAST, BLAST2, ALIGN2 or Megalign (DNASTAR), the relevant residues located on the *P. aeruginosa* azurin amino acid sequence, and the equivalent residues found on the subject cupredoxin sequence, and the equivalent peptide thus designed.

In one embodiment of the invention, the cupredoxin derived peptide comprises at least amino acids 57 to 89 of auracyanin B of *Chlorollexus aurantiacus* (SEQ ID NO: 21). In another embodiment of the invention, the cupredoxin derived peptide comprises at least amino acids 51-77 of *Pseudomonas syringae* azurin (SEQ ID NO: 27). In another embodiment of the invention, the cupredoxin derived peptide comprises at least amino acids 89-115 of *Neisseria meningitidis* Laz (SEQ ID NO: 23). In another embodiment of the invention, the cupredoxin derived peptide comprises at least amino acids 52-78 of *Vibrio parahaemolyticus* azurin (SEQ ID NO: 28). In another embodiment of the invention, the cupredoxin derived peptide comprises at least amino acids 51-77 of *Bordetella bronchiseptica* azurin (SEQ ID NO: 29).

The cupredoxin derived peptides also include peptides made with synthetic amino acids that are not naturally occurring. For example, non-naturally occurring amino acids may be integrated into the variant peptide to extend or optimize the half-life of the composition in the bloodstream. Such variants include, but are not limited to, D,L-peptides (diastereomer), (see, for example Futaki et al., J. Biol. Chem. 276(8):5836-40 (2001); Papo et al., Cancer Res. 64(16):5779-86 (2004); Miller et al, Biochem. Pharmacol. 36(1):169-76, (1987).; peptides containing unusual amino acids (see, for example Lee et al., J. Pept. Res. 63(2):69-84 (2004)), olefin-containing non-natural amino acid followed by hydrocarbon stapling (see, for example Schafmeister et al., J. Am. Chem. Soc. 122:5891-5892 (2000); Walenski et al., Science 305:1466-1470 (2004)), and peptides comprising ε-(3,5-dinitrobenzoyl)-Lys residues.

In other embodiments, the cupredoxin derived peptide is a derivative of a cupredoxin. The derivatives of cupredoxin are chemical modifications of the peptide such that the peptide still retains some of its fundamental pharmacologic activities. For example, a "derivative" of azurin can be a chemically modified azurin that retains its ability to inhibit the growth of mammalian cancer cells. Chemical modifications of interest include, but are not limited to, hydrocarbon stabling, amidation, acetylation, sulfation, polyethylene glycol (PEG) modification, phosphorylation and glycosylation of the peptide. In addition, a derivative peptide maybe a fusion of a cupredoxin, or variant, derivative or structural equivalent thereof to a chemical compound, such as but not limited to, another peptide, drug molecule or other therapeutic or pharmaceutical agent or a detectable probe. Derivatives of interest include chemical modifications by which the half-life in the bloodstream of the peptides and compositions of the invention can be extended or optimized, such as by several methods well known to those in the art, including but not limited to, circularized peptides (see, for example Monk et al., BioDrugs 19(4):261-78, (2005); DeFreest et al., J. Pept. Res. 63(5):409-19 (2004)), N- and C-terminal modifications (see, for example Labrie et al., Clin. Invest. Med. 13(5):275-8, (1990)), and olefin-containing non-natural amino acid followed by hydrocarbon stapling (see, for example Schafmeister et al., J. Am. Chem. Soc. 122:5891-5892 (2000); Walenski et al., Science 305: 1466-1470 (2004)).

In another embodiment, the peptide is a structural equivalent of a cupredoxin or a truncation of a cupredoxin. Examples of studies that determine significant structural homology between cupredoxins and other proteins include Toth et al. (Developmental Cell 1:82-92 (2001)). Specifically, significant structural homology between a cupredoxin and the structural equivalent is determined by using the VAST algorithm. Gibrat et al., Curr Opin Struct Biol 6:377-385 (1996); Madej et al., Proteins 23:356-3690 (1995). In specific embodiments, the VAST p value from a structural comparison of a cupredoxin to the structural equivalent is less than about $10^{-3}$, less than about $10^{-5}$, or less than about $10^{-7}$. In other embodiments, significant structural homology between a cupredoxin and the structural equivalent is determined by using the DALI algorithm. Holm & Sander, J. Mol. Biol. 233:123-138 (1993). In specific embodiments, the DALI Z score for a pairwise structural comparison is at least about 3.5, at least about 7.0, or at least about 10.0.

One specific cupredoxin derived peptide of interest is a fusion of the entry domain of cupredoxin with a cargo compound. In some embodiments, cupredoxin derived peptides may specifically enter into a mammalian cancer cell, and thus may be used to deliver a cargo compound into a cell, and specifically into a cancer cell. A cupredoxin transport peptide comprises a cupredoxin entry domain. The term "cupredoxin entry domain" refers to a fragment of a cupredoxin that includes the amino sequence that is required for the entry of cupredoxin into a mammalian cancer cell. In specific embodiments, the cupredoxin transport peptide is SEQ ID NOS: 13-17, or equivalent residues from another cupredoxin. The present invention encompasses cupredoxin transport peptides complexed with cargo compounds that have been modified to improve their pharmacokinetic properties. The cargo compound as well as the cupredoxin transport peptide may be modified by the methods described herein to improve pharmacokinetic properties. These complexes can then be used in the methods of the invention to deliver the cargo compound into mammalian cancer cells to treat patients suffering from cancer. Cargo compounds delivered by the materials and methods of the present invention include, but are not limited to, proteins, lipoproteins, polypeptides, peptides, polysaccharides, nucleic acids, including anti-sense nucleic acids, dyes, fluorescent and radioactive tags, microparticles or nanoparticles, toxins, inorganic and organic molecules, small molecules, and drugs. In some embodiments, the drugs and toxins kill tumor cells. Such cupredoxin transport peptides and complexes made with them are provided in U.S. patent application Ser. No. 11/244,105, filed Oct. 6, 2005, which is expressly incorporated herein by reference in its entirety.

In some embodiments, amino acids residues in the cupredoxin derived peptides that are conserved among cupredoxins with the desired pharmacologic activity are conserved in modified cupredoxin derived peptides with improved pharmacokinetic properties. For example, it is known that within the cupredoxin entry domain of *Pseudomonas aeruginosa* azurin, several residues are conserved among azurins and azurin-like proteins from several species, *Pseudomonas aeruginosa, Pseudomonas syringae. Neisseria gonorrhoeae, Vibrio parahaemolyticus*, and *Bordetella bronchiseptica.* Yamada et al., Cell. Microbiol, 7:1418-1431 (2005). In some embodiments, the cupredoxin derived peptide retains one or more amino acid residues corresponding to residues 62, 63, 69, 72, 74 and 77 *P. aeruginosa* azurin (SEQ IS NO: 1). In another embodiment, the cupredoxin peptide comprises a conserved amino acid sequence DCXXXXXDXXYXKXXD (SEQ ID NO: 46) or DGXXXXDXXYXKXXD (SEQ ID NO: 47) where D is aspartic acid, G is glycine, Y is tyrosine, K is lysine and X is any amino acid.

Modifications

The present invention relates to modifications of cupredoxin derived peptides that are variants or derivatives, and in specific embodiments, maintain one or more pharmacologic activities, and/or that improve the pharmacokinetic properties of the peptide. These modifications include, but are not limited to, variants and derivatives of the peptides that may increase their stability, specific activity, plasma half life, and/or decrease immunogenicity of the cupredoxin derived peptide, while retaining the ability of the cupredoxin to enter mammal cancer cells and/or inhibit the growth of mammalian cancer cells. Such variants include, but are not limited to, those which decrease the hydrolysis of the peptide, decrease the deamidation of the peptide, decrease the oxidation, decrease the immunogenicity and/or increase the structural stability of the peptide. It is contemplated that two or more of the modifications described herein may be combined in one modified cupredoxin derived peptide, as well as combinations of one or more modifications described herein with other modification to improve pharmacokinetic properties that are well know to those in the art. Many methods to design such variants and derivatives are well know in the art.

Biotransformation

One approach to improving the pharmacokinetic properties of the peptides is to create variants and derivatives of the cupredoxin derived peptides that are less susceptible to biotransformation. Biotransformation may decrease the pharmacologic activity of the peptide as well as increase the rate at which it is eliminated from the patient's body. One way of achieving this is to determine the amino acids and/or amino acid sequences that are most likely to be biotransformed and to replace these amino acids with ones that are not susceptible to that particular transformative process.

Hydrolysis is generally a problem in peptides containing aspartate. Aspartate is susceptible to dehydration to form a cyclic imide intermediate, causing the aspartate to be converted to the potentially inactive iso-aspartate analog, and ultimately cleaving the peptide chain. For example, in the presence of aspartic acid-proline in the peptide sequence, the acid catalyzed formation of cyclic imide intermediate can result to cleavage of the peptide chain. Similarly, in the presence of aspartic acid-glycine in the peptide sequence, the cyclic intermediate can be hydrolyzed either into the original aspartate form (harmless) or into the iso-aspartate analog. Eventually, all of the aspartate form can be completely converted into the iso-aspartate analog. Similarly sequences with serine can also be dehydrated to form a cyclic imide intermediate that can cleave the peptide chain. Cleavage of the peptide may result in reduced plasma half-life as well as reduced specific pharmacologic activity of the peptide.

It is contemplated that substituting other amino acids for asparagine and/or serine in the sequence of the cupredoxin derived peptide may result in a peptide with improved pharmacokinetic properties such as a longer plasma half-life and increased specific activity of a pharmacologic activity of the peptide. In one contemplated variant, at one or more asparagine residues of the cupredoxin derived peptide may be replaced with another amino acid residue, and specifically a glutamic acid residue. In another contemplated variant, one or more serine residues of the cupredoxin derived peptide may be replaced with another amino acid residue, and specifically a threonine residue. In some variants of cupredoxin derived peptide, one or more asparagine residues and one or more serine residues are substituted. In some embodiments, conservative substitutions are made. In other embodiments, non-conservative substitutions are made.

Deamidation of amino acid residues is a particular problem in biotransformation. This base-catalyzed reaction frequently occurs in sequences containing asparagine-glycine or glutamine-glycine and follows a mechanism analogous to the aspartic acid-glycine sequence above. The de-amidation of the asparagine-glycine sequence forms a cyclic imide intermediate that is subsequently hydrolyzed to form the aspartate or iso-asparate analog of asparagine. In addition, the cyclic imide intermediate can lead to racemization into D-aspartic acid or D-iso-aspartic acid analogs of asparagine, all of which can potentially lead to inactive forms of the peptide.

It is contemplated that deamidation in the cupredoxin peptides may be prevented by replacing a glycine, asparagine and/or glutamine of the asparagine-glycine or glutamine-glycine sequences of the cupredoxin with another amino acid and may result in a peptide with improved pharmacokinetic properties, such as a longer plasma half-life and increased specific activity of a pharmacologic activity of the peptide. In some embodiments, the one or more glycine residues of the cupredoxin derived peptide are replaced by another amino acid residue. In specific embodiments, one or more glycine residues of the cupredoxin derived peptide are replaced with a threonine or an alanine residue. In some embodiments, the one or more asparagine or glutamine residues of the cupredoxin derived peptide are replaced by another amino acid residue. In specific embodiments, one or more asparagine or glutamine residues of the cupredoxin derived peptide are replaced with an alanine residue. In other specific embodiments, the glycine at residues 58 and/or 63 of *P. aeruginosa* azurin (SEQ ID NO: 1), or equivalent glycines of other cupredoxins, are replaced with an alanine or a threonine. In other specific embodiments, the methionine at residue 59 of *P. aeruginosa* azurin (SEQ ID NO: 1), or an equivalent methionine residue of another cupredoxin derived peptide, is replaced by an alanine residue. In other specific embodiments, the glycine at residue 63 of *P. aeruginosa* azurin (SEQ ID NO: 1), or an equivalent glycine residue of another cupredoxin derived peptide, is replaced by an threonine residue. In some embodiments, conservative substitutions are made. In other embodiments, non-conservative substitutions are made. In specific embodiments, the modified cupredoxin derived peptide of the invention comprises the following sequence, wherein the underlined amino acids are substituted into the wildtype *Pseudomonas aeruginosa* azurin sequence:

LSTAADMQAVVTDTMASGLDKDYLKPDD. (SEQ ID NO: 30)

Reversible and irreversible oxidation of amino acids are other biotransformative processes that may also pose a problem that may reduce the pharmacologic activity, and/or plasma half-life of cupredoxin derived peptides. The cysteine and methionine residues are the predominant residues that undergo reversible oxidation. Oxidation of cysteine is accelerated at higher pH, where the thiol is more easily deprotonated and readily forms intra-chain or inter-chain disulfide bonds. These disulfide bonds can be readily reversed in vitro by treatment with dithiothreitol (DTT) or tris(2-carboxyethylphosphine) hydrochloride (TCEP). Methionine oxidizes by both chemical and photochemical pathways to form methionine sulfoxide and further into methionine sulfone, both of which are almost impossible to reverse.

It is contemplated that oxidation in the cupredoxin derived peptides may be prevented by replacing methionine and/or cysteine residues with other residues. In some embodiments, one or more methionine and/or cysteine residues of the cupredoxin derived peptide are replaced by another amino acid residue. In specific embodiments, the methionine residue is replaced with a leucine or valine residue. In other specific embodiments, one or more of the methionines at residues 56 and 64 of *P. aeruginosa* azurin (SEQ ID NO: 1), or equivalent methionine residues in other cupredoxin derived peptides, are replaced with leucine or valine. In some embodiments, conservative substitutions are made. In other embodiments, non-conservative substitutions are made. In specific embodiments, the cupredoxin peptides of the invention comprise one of the following sequences, wherein the underlined amino acid is substituted into the wildtype *Pseudomonas aeruginosa* azurin sequence:

LSTAADLQGVVTDGLASGLDKDYLKPDD (SEQ ID NO: 31)
or

LSTAADVQGVVTDGVASGLDKDYLKPDD. (SEQ ID NO: 32)

Another biotransformative process that may affect the pharmacologic activity, plasma half-life and/or immunogenicity of the cupredoxin derived peptides is diketopiperazine and pyroglutamic acid formation. Diketopiperazine formation usually occurs when glycine is in the third position from the N-terminus, and more especially if proline or glycine is in position 1 or 2. The reaction involves nucleophilic attack of the N-terminal nitrogen on the amide carbonyl between the second and third amino acid, which leads to the cleavage of the first two amino acids in the form of a diketopiperazine. On the other hand, pyroglutamic acid formation may be almost inevitable if glutamine is in the N-terminus. This is an analogous reaction where the N-terminal nitrogen attacks the side chain carbonyl carbon of glutamine to form a deaminated pyroglutamyl peptide analog. This conversion also occurs in peptide containing asparagine in the N-terminus, but to a much lesser extent.

It is contemplated that diketopiperazine and pyroglutamic acid formation may be decreased in cupredoxin derived peptides by replacing glycine in position 1, 2, or 3 from the N-terminus, proline in position 3 from the N-terminus, or asparagine at the N-terminus of the peptide with another amino acid residue. In some embodiments, a glycine in positions 1, 2, or 3 from the N-terminus of the cupredoxin derived peptide is replaced with another amino acid residue. In specific embodiments, the glycine residue is replaced by a threonine or alanine residue. In another embodiment, a proline at position 3 from the N-terminus of the cupredoxin derived peptide is replaced with another amino acid residue. In specific embodiments, the proline is replaced by an alanine residue. In another embodiment, an asparagine at the N-terminus is replaced with another amino acid residue. In specific embodiments, the asparagine residue is replaced by a glutamine residue. In some embodiments, conservative substitutions are made. In other embodiments, non-conservative substitutions are made.

Another biotransformative process that may affect the pharmacologic activity, plasma half-life and/or immunogenicity of the cupredoxin derived peptide is racemization. This term is loosely used to refer to the overall loss of chiral integrity of the amino acid or peptide. Racemization involves the base-catalyzed conversion of one enantiomer (usually the L-form) of an amino acid into a 1:1 mixture of L- and D-enantiomers. One way to improve stability of the peptide in general is by making a retro-inverso (D-isomer) peptide. The double inversion of peptide structure often leaves the surface topology of the side-chain intact and has been used extensively to stabilize biologically active peptides. Snyder et al., PLoS Biol. 2:0186-0193 (2004). A D-amino acid substituted Tat is internalized into cells as well as the L-amino acid peptide. Futaki et al., J. Biol. Chem. 276:5836-5840 (2001); Huq et al., Biochemistry 38:5172-5177 (1999). In some embodiments, one or more amino acid residues of the cupredoxin derived peptide are replaced by the D-isomer of that amino acid residue. In other embodiments, all of the amino acid residues of the cupredoxin derived peptide are replaced with D-isomers of those residues. In one embodiment, the modified cupredoxin derived peptide is a retro-inverso (D-isomer) version of the cupredoxin derived peptide. In a specific embodiment, the modified cupredoxin derived peptide is

DDPKLYDKDLGSAMGDTVVGQMDAATSL. (SEQ ID NO: 45)

Other methods to protect a cupredoxin derived peptide from biotransformative degradation are N-acetylation and C-amidation. These derivatives may protect the peptide from degradation and may make the cupredoxin derived peptide more closely mimic the charge state of the alpha amino and carboxyl groups in the native protein. Peptides with the N-acetylation and/or C-amidation can be provided by commercial suppliers. In one embodiment of the invention, the N-terminus of the cupredoxin derived peptide may be acetylated. In another embodiment of the invention, the C-terminus of the cupredoxin derived peptides may be amidated. In one specific embodiment, the modified cupredoxin derived peptide is (SEQ ID NO: 33)
Acetylation-LSTAADMQGVVTDGMASGLDKDYLKPDD-amidation.

Tertiary Structure Stabilization

The stability of the tertiary structure of the cupredoxin derived peptide will affect most aspects of the pharmacokinetics, including the pharmacologic activity, plasma half-life, and/or immunogenicity among others. See Kanovsky et al., Cancer Chemother. Pharmacol. 52:202-208 (2003);

Kanovsky et al., PNAS 23:12438-12443 (2001). Peptide helices often fall apart into random coils, becoming more susceptible to protease attack and may not penetrate cell membrane well. Schafmeister et al., J. Am. Chem. Soc. 122:5891-5892 (2000). Therefore, one way to stabilize the overall structure of the peptide is to stabilize the α-helix structure of the peptide. The intra-molecular hydrogen bonding associated with helix formation reduces the exposure of the polar amide backbone, thereby reducing the barrier to membrane penetration in a transport peptide, and thus increasing related pharmacologic activities and increasing the resistance of the peptide to protease cleavage. Id. *Pseudomonas aeruginosa* azurin (SEQ ID NO: 1) has α-helices at residues 53-56, 58-64 and 68-70.

One method to stabilize an α-helix is to replace in the α-helix helix breaking amino acid residues such as glycine, proline, serine and aspartic acid, or helix neutral amino acid residues such as alanine, threonine, valine, glutamine, asparagine, cysteine, histidine, lysine or arginine, with helix forming residues, such as leucine, isoleucine, phenylalanine, glutamic acid, tyrosine, tryptophan and methionine. It is contemplated that the α-helix of cupredoxin derived peptides may be stabilized by replacing one or more glycine, proline, serine and/or aspartic acid residues with other amino acids. In specific embodiments, the glycine, proline, serine, aspartic acid, alanine, threonine, valine, glutamine, asparagine, cysteine, histidine, lysine and/or arginine residues are replaced by leucine, isoleucine, phenylalanine, glutamic acid, tyrosine, tryptophan and/or methionine residues. See Lee et al., Cancer Cell Intl. 11:21 (2005). In other specific embodiments, one or more serine or glutamine residues in the α-helices of a cupredoxin derived peptide may be substituted. In still more specific embodiments, the serine and/or glutamine residues in residues 53-56, 58-64 and 68-70 of *P. aeruginosa* azurin (SEQ ID NO: 1), or equivalent residues of other cupredoxin derived peptides, may be replaced. In another specific embodiment, the glutamine residue at amino acid residue 57 of *P. aeruginosa* azurin (SEQ ID NO: 1), or an equivalent residue of another cupredoxin derived peptide, may be replaced, more specifically replaced with tryptophan. In another specific embodiment, the threonine residue at amino acid residue 52 of *P. aeruginosa* azurin (SEQ ID NO: 1), or an equivalent residue of another cupredoxin derived peptide, may be replaced, more specifically replaced with tryptophan. In another specific embodiment, the threonine residue at amino acid residue 61 of *P. aeruginosa* azurin (SEQ ID NO: 1), or an equivalent residue of another cupredoxin derived peptide, may be replaced, more specifically replaced with tryptophan. In another specific embodiment, the glycine residue at amino acid residue 63 of *P. aeruginosa* azurin (SEQ ID NO: 1), or an equivalent residue of another cupredoxin derived peptide, may be replaced, more specifically replaced with tryptophan. In another specific embodiment, one or more threonine, glutamine or glycine residues at amino acid residues 52, 57, 61 or 63 of *P. aeruginosa* azurin (SEQ ID NO: 1), or an equivalent residue of another cupredoxin derived peptide, may be replaced, more specifically replaced with tryptophan. In specific embodiments, the cupredoxin peptide comprises one of the following sequences wherein the underlined amino acid is substituted into the wildtype *Pseudomonas aeruginosa* azurin sequence:

```
LSWAADMQGVVTDGMASGLDKDYLKPDD;    (SEQ ID NO: 34)

LSTAADMWGVVTDGMASGLDKDYLKPDD;    (SEQ ID NO: 35)

LSTAADMQGVVWDGMASGLDKDYLKPDD;    (SEQ ID NO: 36)
```

-continued
```
LSTAADMQGVVTDWMASGLDKDYLKPDD;    (SEQ ID NO: 37)

LSWAADMWGVVTDGMASGLDKDYLKPDD:    (SEQ ID NO: 38)

LSWAADMQGVVWDGMASGEDKDYLKPDD:    (SEQ ID NO: 39)

LSWAADMQGVVTDWMASGLDKDYLKPDD;    (SEQ ID NO: 40)

LSTAADMWGVVWDGMASGLDKDYLKPDD;    (SEQ ID NO: 41)

LSTAADMWGVVTDWMASGLDKDYLKPDD;    (SEQ ID NO: 42)

LSTAADMQGVVWDWMASGLDKDYLKPDD;    (SEQ ID NO: 43)
or

LSWAADMWGVVWDWMASGLDKDYLKPDD.    (SEQ ID NO: 44)
```

In other embodiments, equivalent amino acids in other cupredoxin derived peptides are substituted with tryptophan.

Another method to stabilize an α-helix tertiary structure involves using unnatural amino acid residues capable of π-stacking. For example, in Andrews and Tabor (Tetrahedron 55:11711-11743 (1999)), pairs of ε-(3,5-dinitrobenzoyl)-Lys residues were substituted into the α-helix region of a peptide at different spacings. The overall results showed that the i,(i+4) spacing was the most effective stabilizing arrangement. Increasing the percentage of water, up to 90%, increased the helical content of the peptide. Pairs of ε-acyl-Lys residues in the same i,(i+4) spacing had no stabilizing effect, indicating that the majority of the stabilization arises from π-π interactions. In one embodiment, the cupredoxin derived peptide may be modified so that the lysine residues are substituted by ε-(3,5-dinitrobenzoyl)-Lys residues. In a specific embodiment, the lysine residues may be substituted by ε-(3,5-dinitrobenzoyl)-Lys in a i,(i+4) spacing.

Another method to stabilize an α-helix tertiary structure uses the electrostatic interactions between side-chains in the α-helix. When His-Cys or His-His residue pairs were substituted in into peptides in an i,(i+4) arrangement, the peptides changed from about 50% helical to about 90% helical on the addition of Cu, Zn or Cd ions. When ruthenium (Ru) salts were added to the His-His peptides, an exchange-inert complex was formed, a macrocyclic cis-[Ru—(NH$_3$)$_4$L$_2$]$^{3+}$ complex where L$_2$ are the side chains of two histidines, which improved the helix stability. Ghadiri and Fernholz, J. Am. Chem. Soc. 112, 9633-9635 (1990). In some embodiments, the cupredoxin derived peptides may comprise macrocyclic cis-[Ru—(NH$_3$)$_4$L$_2$]$^{3+}$ complexes where L$_2$ is the side chains of two histidines. In some embodiments, one or more histidine-cysteine or histidine-histidine residue pairs may be substituted an i,(i+4) arrangement into the α-helices of the cupredoxin derived peptide. In other embodiments, one or more histidine-cysteine or histidine-histidine residue pairs may be substituted an i,(i+4) arrangement in residues 53-56, 58-64 and 68-70 of *P. aeruginosa* azurin (SEQ. ID NO: 1), or equivalent residues of other cupredoxin derived peptides. In some embodiments, the cupredoxin derived peptide may further comprise Cu, Zn, Cd and/or Ru ions.

Another method to stabilize an α-helix tertiary structure involves disulfide bond formation between side-chains of the α-helix. It is also possible to stabilize helical structures by means of formal covalent bonds between residues separated in the peptide sequence. The commonly employed natural method is to use disulfide bonds. Pierret et al., Intl. J. Pept. Prot. Res., 46:471-479 (1995). In some embodiments, one or more cysteine residue pairs are substituted into the α-helices of the cupredoxin derived peptide. In other embodiments, one or more cysteine residue pairs are substituted at residues 53-56, 58-64 and 68-70 of *P. aeruginosa* azurin (SEQ ID NO: 1), or equivalent residues of other cupredoxin derived peptides.

Another method to stabilize an α-helix tertiary structure is the all-carbon cross-link method. The all-hydrocarbon cross-link method is proven to increase the stabilization of helical structure, protease resistant and cell-permeability. Walensky et al., Science, 305, 1466-1470 (2004). α,α-disubstituted non-natural amino acids containing olefin-bearing tethers are incorporated into peptides. Ruthenium catalyzed olefin metathesis generates an all-hydrocarbon "staple" to cross-link the helix. Schafmeister et al., J. Am. Chem. Soc., 122, 5891-5892 (2000); Walensky et al., id. Non-natural amino acids containing olefin-bearing tethers may be synthesized according to methodology provided in Schafmeister et al. (id.) and Williams and Im (J. Am. Chem. Soc., 113:9276-9286 (1991)). In some embodiments, the cupredoxin derived peptides are stabilized by all-hydrocarbon staples. In specific embodiments, one or more pairs of α,α-disubstituted non-natural amino acids containing olefin-bearing tethers corresponding to the native amino acids are substituted into the α-helices of the cupredoxin derived peptide. In other embodiments, one or more pairs of α,α-disubstituted non-natural amino acids containing olefin-bearing tethers corresponded to the native amino acids are substituted into residues 53-56, 58-64 and 68-70 of *P. aeruginosa* azurin (SEQ ID NO: 1), or equivalent residues of other cupredoxin derived peptides.

In some embodiments, the modified cupredoxin derived peptide may comprise $X_1SX_2AADX_3X_4X_5VVX_6DX_7X_8$ ASGLDKDYLKPDX$_9$ (SEQ ID NO:48), where $X_1$ is L or acetylated-L, $X_2$ is T or W, $X_3$ is M, L or V, $X_4$ is Q or W, $X_5$ is G or A, $X_6$ is T or W, $X_7$ is G, T or W, $X_8$ is M, L or V, and $X_9$ is D or amidated-D. In other embodiments, the modified cupredoxin derived peptide may consist of $X_1SX_2AADX_3X_4X_5VVX_6DX_7X_8$ASGLDKDYLKPDX$_8$ (SEQ ID NO:48), where $X_1$ is L or acetylated-L, $X_2$ is T or W, $X_3$ is M, L or V, $X_4$ is Q or W, $X_5$ is G or A, $X_6$ is T or W, $X_7$ is G, T or W, $X_8$ is M, L or V, and $X_9$ is D or amidated-D. In other embodiments, the modified cupredoxin derived peptide may comprise $X_1DPKLYDKDLGSAX_2$ $X_3DX_4VVX_5X_6X_7DAAX_8SX_9$ (SEQ ID NO:49), where $X_1$ is D or acetylated-D, $X_2$ is M, L or V, $X_3$ is G, T W, $X_4$ is T or W, $X_5$ is G or A, $X_6$ is Q or W, $X_7$ is M, L or V, $X_8$ is T or W, and $X_9$ is L or amidated-L. In other embodiments, the modified cupredoxin derived peptide may consist of $X_1DPKLYDKDLGSAX_2X_3DX_4VVX_5X_6X_7DAAX_8SX_9$ (SEQ ID NO:49), where $X_1$ is D or acetylated-D, $X_2$ is M, L or V, $X_3$ is G, T or W, $X_4$ is T or W, $X_5$ is G or A, $X_6$ is Q or W, $X_7$ is M, L or V, $X_8$ is T or W, and $X_9$ is L or amidated-L. Specific peptides of interest are listed in Table 3.

PEGylation

Covalent attachment of PEG to drugs of therapeutic and diagnostic importance has extended the plasma half-life of the drug in vivo, and/or reduced their immunogenicity and antigenicity. Harris and Chess, Nature Reviews Drug Discovery 2:214-221 (2003). For example, PEG attachment has improved the pharmacokinetic properties of many therapeutic proteins, including interleukins (Kaufman et al., J. Biol. Chem. 263:15064 (1988); Tsutsumi et al., Controlled Release 33:447 (1995)), interferons (Kita et al., Drug Des. Delivery 6:157 (1990)), catalase (Abuchowski et al., J. Biol. Chem. 252:3582 (1977)), superoxide dismutase (Beauchamp et al, Anal. Biochem. 131:25 (1983)), and adenosine deanimase (Chen et al., Biochem. Biophys. Acta 660:293 (1981)), among others. The FDA has approved PEG for use as a vehicle or base in thuds, cosmetics and pharmaceuticals, including injectable, topical, rectal and nasal formulations, PEG shows little toxicity, and is eliminated from the body intact by either the kidneys (for PEGs<30 kDa) or in the feces (for PEGs>20 kDa). PEG is highly soluble in water.

PEGylation of a therapeutic peptide may be used to increase the lifetime of the peptide in the bloodstream of the patient by reducing renal ultrafiltration, and thus reduce elimination of the drug from the body. Charge masking may affect renal permeation. Charge masking may be a consequence of the paramchemical modification of protein ionizable functional group, namely amines or carboxyls. In particular, the most common procedures for producing protein-PEG derivatives involves the conversion of protein amino groups into amides with the consequent loss of positive charges, and this can alter protein ultrafiltration. Since anionic macromolecules have been found to be cleared by renal ultrafiltration more slowly than neutral or positive ones, it could be expected that PEG conjugation to amino groups prolongs the permanence of the PEGylated peptide in the bloodstream.

Molecular size and globular ultrafiltration may also affect renal ultrafiltration of therapeutic peptides. The molecular weight cut off for kidney elimination of native globular proteins is considered to be about 70 kDa, which is close to the molecular weight of serum albumin. Thus, proteins with molecular weight exceeding 70 kDa are mainly eliminated from the body by pathways other than renal ultrafiltration, such as liver uptake, proteolytic digestion and clearance by the immune system. Therefore, increasing the size of a therapeutic peptide by PEGylation may decrease renal ultrafiltration of that peptide form the bloodstream of the patient.

Additionally, PEGylation of a therapeutic peptide may decrease the immunogenicity of that peptide, as well as protect the peptide from proteolytic enzymes, phagocytic cells, and other factors that require direct contact with the therapeutic peptide. The umbrella-like structure of branched PEG in particular has been found to give better protection than linear PEG towards approaching proteolytic enzymes, antibodies, phagocytic cells, etc. Caliceti and Veronese. Adv. Drug. Deliv. Rev. 55:1261-12778 (2003).

In some embodiments, the cupredoxin derived peptides are modified to have one or more PEG molecules covalently bonded to a cysteine molecule. The covalent bonding does not necessarily need to be a covalent bond directly from the PEG molecule to the cupredoxin derived peptide, but may be covalently bonded to one or more linker molecules which in turn are covalently bonded to each other and/or the cupredoxin derived peptide. In some embodiments, the cupredoxin derived peptide have site-specific PEGylation. In specific embodiments, the PEG molecule(s) may be covalently bonded to the cysteine residues 3, 26 and/or 112 of *P. aeruginosa* azurin (SEQ ID NO: 1). In other embodiments, one or more cysteine residues may be substituted into the cupredoxin derived peptide and is PEGylated. In some embodiments, the method to PEGylate the cupredoxin derived peptide may be NHS, reductive animation, malimid or epoxid, among others. In other embodiments, the cupredoxin derived peptides may be PEGylated on one or more lysine, cysteine, histidine, arginine, aspartic acid, glutamic acid, serine, threonine, or tyrosine, or the N-terminal amino group or the C-terminal carboxylic acid. In more specific embodiments, the cupredoxin derived peptides may be PEGylated on one or more lysines or N-terminal amino groups. In other embodiments, one or more lysine, cysteine, histidine, arginine, aspartic acid, glutamic acid, serine, threonine, or tyrosine residue are substituted into the cupredoxin derived peptides and are PEGylated. In other embodiments, the cupredoxin derived peptides may be PEGylated on one or more amino groups. In other embodiments, the cupredoxin derived peptides may be PEGylated in a random, non-site specific manner. In some embodiments, the cupredoxin derived peptides may have an average molecular weight of PEG-based polymers of about 200 daltons to about 100,000 daltons, about 2,000 daltons to about 20,000 daltons, or about 2,000 daltons to about 5,000 daltons. In other embodiments, the cupredoxin derived peptides may be comprised of one or more PEG molecules that is branched, specifically a branched PEG molecule that is about 50 kDa. In other embodiments, the cupredoxin derived peptides may comprise one or more linear PEG molecules, specifically a linear PEG molecule that is about 5 kDa.

Cupredoxins

"Cupredoxins" are small blue copper containing proteins having electron transfer properties (10-20 kDa) that participate in, for example, bacterial redox chains or photosynthesis. The copper ion is solely hound by the protein matrix. A special distorted trigonal planar arrangement to two histidine and one cysteinate ligands around the copper gives rise to very peculiar electronic properties of the metal site and an intense blue color. A number of cupredoxins have been crystallographically characterized at medium to high resolution. The cupredoxins include the azurins, plastocyanins, rusticyanins, pseudoazurins, auracyanins and azurin-like proteins. As used herein, the term "cupredoxin" includes the protein form without the copper atom present, as well as the copper containing protein.

Azurins

The azurins are copper containing proteins of 128 amino acid residues which belong to the family of cupredoxins involved in electron transfer in plants and certain bacteria. The azurins include those from $P.$ $aeruginosa$ (SEQ ID NO: 1) ("wt-azurin"), $A.$ $xylosoxidans$, and $A.$ $denitrificans$. Murphy et al., J. Mol. Biol. 315:859-871 (2002). Although the sequence homology between the azurins varies between 60-90%, the structural homology between these molecules is high. All azurins have a characteristic β-sandwich with Greek key motif and the single copper atom is always placed at the same region of the protein. In addition, azurins possess an essentially neutral hydrophobic patch surrounding the copper site. Id.

Plastocyanins

The plastocyanins are cupredoxins that are found in eukaryotic plants and cyanobacteria. They contain one molecule of copper per molecule and are blue in their oxidized form. They occur in the chloroplast, where they function as electron carriers. Since the determination of the structure of $poplar$ plastocyanin in 1978, the structure of algal ($Scenedesmus$, $Enteromorpha$, $Chlamydomonas$) and plant (French bean) plastocyanins has been determined either by crystallographic or NMR methods, and the $poplar$ structure has been refined to 1.33 Å resolution. SEQ ID NO: 2 shows the amino acid sequence of plastocyanin from the cyanobacterium. $Phormidium$ $laminosum.$ Despite the sequence divergence among plastocyanins of algae and vascular plants (e.g., 62% sequence identity between the $Chlamydomonas$ and $poplar$ proteins), the three-dimensional structures are conserved (e.g., 0.76 Å rms deviation in the C alpha positions between the $Chlamydomonas$ and $Poplar$ proteins). Structural features include a distorted tetrahedral copper binding site at one end of an eight-stranded antiparallel beta-barrel, a pronounced negative patch, and a flat hydrophobic surface. The copper site is optimized for its electron transfer function, and the negative and hydrophobic patches are proposed to be involved in recognition of physiological reaction partners. Chemical modification, cross-linking, and site-directed mutagenesis experiments have confirmed the importance of the negative and hydrophobic patches in binding interactions with cytochrome f, and validated the model of two functionally significant electron transfer paths in plastocyanin. One putative electron transfer path is relatively short (approximately 4 Å) and involves the solvent-exposed copper ligand His-87 in the hydrophobic patch, while the other is more lengthy (approximately 12-15 Å) and involves the nearly conserved residue Tyr-83 in the negative patch. Redinbo et al., J. Bioenerg. Biomembr. 26(1):49-66 (1994).

Rusticyanins

Rusticyanins are blue-copper containing single-chain polypeptides obtained from a $thiobacillus$. The X-ray crystal structure of the oxidized form of the extremely stable and highly oxidizing cupredoxin rusticyanin from $Thiobacillus$ $ferrooxidans$ (SEQ ID NO: 3) has been determined by multiwavelength anomalous diffraction and refined to 1.9 Å resolution. The rusticyanins are composed of a core beta-sandwich fold composed of a six- and a seven-stranded O-sheet. Like other cupredoxins, the copper ion is coordinated by a cluster of four conserved residues (His 85, Cys138, His143, Met148) arranged in a distorted tetrahedron. Walter et al., J. Mol. Biol. 263:730-51 (1996).

Auracyanins

Three small blue copper proteins designated auracyanin A, auracyanin B 1, and auracyanin B-2 have been isolated from the thermophilic green gliding photosynthetic bacterium $Chloroflexus$ $aurantiacus$. The two B forms have almost identical properties to each other, but are distinct from the A form. The sodium dodecyl sulfate-polyacrylamide gel electrophoresis demonstrates apparent monomer molecular masses as 14 (A). 18 (B-2), and 22 (B-1) kDa.

The amino acid sequence of auracyanin A has been determined and showed auracyanin A to be a polypeptide of 139 residues. Van. Dreissche et al, Protein Science 8:947-957 (1999). His58, Cys123, His128, and Met132 are spaced inn a way to be expected if they are the evolutionary conserved metal ligands as in the known small copper proteins plastocyanin and azurin. Secondary structure prediction also indicates that auracyanin has a general beta-barrel structure similar to that of azurin from $Pseudomonas$ $aeruginosa$ and plastocyanin from $poplar$ leaves. However, auracyanin appears to have sequence characteristics of both small copper protein sequence classes. The overall similarity with a consensus sequence of azurin is roughly the same as that with a consensus sequence of plastocyanin, namely 30.5%. The N-terminal sequence region 1-18 of auracyanin is remarkably rich in glycine and hydroxy amino acids. Id. See exemplary amino acid sequence SEQ ID NO: 10 for chain A of auracyanin from $Chloroflexus$ $aurantiacus$ (NCBI Protein Data Bank Accession No. AAM12874).

The auracyanin B molecule has a standard cupredoxin fold. The crystal structure of auracyanin B from $Chloroflexus$ $aurantiacus$ has been studied. Bond et al., J. Mol. Biol. 306:47-67 (2001). With the exception of an additional N-terminal strand, the molecule is very similar to that of the bacterial cupredoxin, azurin. As in other cupredoxins, one of the Cu ligands lies on strand 4 of the polypeptide, and the other three lie along a large loop between strands 7 and 8. The Cu site geometry is discussed with reference to the amino acid spacing between the latter three ligands. The crystallographically characterized Cu-binding domain of auracyanin B is probably tethered to the periplasmic side of the cytoplasmic membrane by an N-terminal tail that exhibits significant sequence identity with known tethers in several other membrane-associated electron-transfer proteins. The amino acid sequences of the B forms are presented in McManus et al. (J Biol Chem. 267:6531-6540 (1992)). See exemplary amino acid sequence SEQ ID NO: 11 for chain A of auracyanin B from *Chloroflexus aurantiacus* (NCBI Protein Data Bank Accession No. 1QHQA).

Pseudoazurins

The pseudoazurins are a family of blue-copper containing single-chain polypeptides. The amino acid sequence of pseudoazurin obtained from *Achromobacter cycloclastes* is shown in SEQ ID NO: 4. The X-ray structure analysis of pseudoazurin shows that it has a similar structure to the azurins although there is low sequence homology between these proteins. Two main differences exist between the overall structure of the pseudoazurins and azurins. There is a carboxy terminus extension in the pseudoazurins, relative to the azurins, consisting of two alpha-helices. In the mid-peptide region azurins contain an extended loop, shortened in the pseudoazurins, which forms a flap containing a short α-helix. The only major differences at the copper atom site are the conformation of the MET side-chain and the Met-S copper bond length, which is significantly shorter in pseudoazurin than in azurin.

The modified cupredoxin derived peptides may be synthesized by standard techniques. Variants are amino acid sequences formed from native compounds either directly or by modification or partial substitution. Changes may be introduced into a cupredoxin derived peptide that incur alterations in the amino acid sequences of the cupredoxin derived peptide that do nullify the pharmacologic activity(ies) of the cupredoxin. A "non-essential" amino acid residue is a residue that can be altered from the sequence of the cupredoxin derived peptide without nullifying its pharmacologic activity, whereas an "essential" amino acid residue is required for such pharmacologic activity.

Amino acids for which "conservative" substitutions can be made are well known in the art. Useful conservative substitutions are shown in Table 1, "Preferred substitutions." Conservative substitutions whereby an amino acid of one class is replaced with another amino acid of the same class fall within the scope of the invention so long as the substitution does not nullify the desired pharmacologic activity of the cupredoxin derived peptide. Such exchanges that result in altered cupredoxin derived pharmacologic activity are contemplated as part of the invention so long as such pharmacologic activity is appreciable. In some embodiments, the pharmacologic activity of the cupredoxin derived peptide is less that about 5%, less than about 10%, less than about 25% and less than about 50% of the specific activity of the wildtype cupredoxin from which it is derived. It will be appreciated that some loss of specific activity of the cupredoxin derived peptide may be tolerated if it is offset by other improved qualities in the cupredoxin derived peptide, such as longer plasma half-life or decreased immunogenicity.

TABLE 1

Preferred substitutions

| Original residue | Exemplary substitutions | Preferred substitutions |
| --- | --- | --- |
| Ala (A) | Val, Leu, Ile | Val |
| Arg (R) | Lys, Gln, Asn | Lys |
| Asn (N) | Gln, His, Lys, Arg | Gln |
| Asp (D) | Glu | Glu |
| Cys (C) | Ser | Ser |
| Gln (Q) | Asn | Asn |
| Glu (E) | Asp | Asp |
| Gly (G) | Pro, Ala | Ala |
| His (H) | Asn, Gln, Lys, Arg | Arg |
| Ile (I) | Leu, Val, Met, Ala, Phe, Norleucine | Leu |
| Leu (L) | Norleucine, Ile, Val, Met, Ala, Phe | Ile |
| Lys (K) | Arg, Gln, Asn | Arg |
| Met (M) | Leu, Phe, Ile | Leu |
| Phe (F) | Leu, Val, Ile, Ala, Tyr | Leu |
| Pro (P) | Ala | Ala |
| Ser (S) | Thr | Thr |
| Thr (T) | Ser | Ser |
| Trp (W) | Tyr, Phe | Tyr |
| Tyr (Y) | Trp, Phe, Thr, Ser | Phe |
| Val (V) | Ile, Leu, Met, Phe, Ala, Norleucine | Leu |

"Non-conservative" substitutions that affect (1) the structure of the polypeptide backbone, such as a β-sheet or α-helical conformation, (2) the charge, (3) hydrophobicity, or (4) the bulk of the side chain can modify pharmacologic activity of a cupredoxin derived peptide. Residues are divided into groups based on common side-chain properties as denoted in Table 2. Non-conservative substitutions entail exchanging a member of one of these classes for another class.

Non-conservative substitutions whereby an amino acid of one class is replaced with another amino acid of a different class fall within the scope of the invention so long as the substitution does not nullify the pharmacologic activity of the cupredoxin derived peptide. Such exchanges that result in altered cupredoxin derived peptide pharmacologic activity are contemplated as part of the invention so long as such pharmacologic activity is appreciable.

TABLE 2

Amino acid classes

| Class | Amino acids |
| --- | --- |
| hydrophobic | Norleucine, Met, Ala, Val, Leu, Ile |
| neutral hydrophilic | Cys, Ser, Thr |
| acidic | Asp, Glu |
| basic | Asn, Gln, His, Lys, Arg |
| disrupt chain conformation | Gly, Pro |
| aromatic | Trp, Tyr, Phe |

Modifications to the cupredoxin derived peptide can be made using methods known in the art such as oligonucleotide-mediated (site-directed) mutagenesis, alanine scanning, and PCR mutagenesis. Site-directed mutagenesis (Carter, Biochem J. 237:1-7 (1986); Zoller and Smith, Methods Enzymol. 154:329-50 (1987)), cassette mutagenesis, restriction selection mutagenesis (Wells et al., Gene 34:315-23 (1985)) or other known techniques can be performed on the cloned DNA to produce a cupredoxin derived peptide encoding variant nucleic acid. In addition, nucleotides encoding a cupredoxin derived peptide that is a structural equivalent of a cupredoxin may be synthesized by methods that are well known in the art. Further, protein molecules that are modified cupredoxin derived peptide may be synthesized by methods that are well known in the art.

Nucleic Acids Coding for a the Cupredoxin Entry Domain and Complex of a Cupredoxin Entry Domain Linked to a Cargo Compound In another aspect, the present invention provides a nucleic acid molecule encoding a modified cupredoxin derived peptide of the invention. This nucleic acid molecule can be prepared by a combination of known techniques in the art. For instance, nucleic acid sequences for the modified cupredoxin derived peptide can individually be prepared by chemical synthesis or cloning.

Pharmaceutical Compositions Containing a Modified Cupredoxin Derived Peptides

Pharmaceutical compositions containing a modified cupredoxin derived peptide can be manufactured in any conventional manner, e.g., by conventional mixing, dissolving, granulating, dragee-making, emulsifying, encapsulating, entrapping, or lyophilizing processes. The modified cupredoxin derived peptide can be readily combined with a pharmaceutically acceptable carrier well-known in the art. Such carriers enable the preparation to be formulated as a tablet, pill, dragee, capsule, liquid, gel, syrup, slurry, suspension, and the like. Suitable excipients can also include, for example, fillers and cellulose preparations. Other excipients can include, for example, flavoring agents, coloring agents, detackifiers, thickeners, and other acceptable additives, adjuvants, or binders.

Such compositions can be used in, for example, the treatment or diagnosis of cancer, treatment of inappropriate angiogenesis, infection by HIV and/or malaria, and treatment of conditions related to ephrin-signaling. The compositions can be administered in an amount sufficient to prevent or treat the condition from which the patient is suffering. Typically, the patient organism is a mammal, such as a human or animal.

Administration of Compositions Containing a Cupredoxin Entry Domain

Compositions containing a modified cupredoxin derived peptide can be administered by any suitable route, for example, by oral, buccal, inhalation, sublingual, rectal, vaginal, transurethral, nasal, topical, percutaneous, i.e., transdermal or parenteral (including intravenous, intramuscular, subcutaneous and intracoronary administration). The compositions and pharmaceutical formulations thereof can be administered in any amount effective to achieve its intended purpose. When administrated to treat a patient suffering from a condition, the composition is administered in a therapeutically effective amount. A "therapeutically effective amount" is an amount effective to prevent development of, or to alleviate the existing symptoms of, the subject being treated. Determination of a therapeutically effective amount is well within the capability of those skilled in the art.

In various embodiments, the composition includes carriers and excipients (including but not limited to buffers, carbohydrates, mannitol, proteins, polypeptides or amino acids such as glycine, antioxidants, bacteriostats, chelating agents, suspending agents, thickening agents and/or preservatives), water, oils, saline solutions, aqueous dextrose and glycerol solutions, other pharmaceutically acceptable auxiliary substances as required to approximate pharmacologic conditions, such as buffering agents, tonicity adjusting agents, wetting agents and the like. It will be recognized that, while any suitable carrier known to those of ordinary skill in the art may be employed to administer the compositions of this invention, the type of carrier will vary depending on the mode of administration. Compounds may also be encapsulated within liposomes using well-known technology. Biodegradable microspheres may also be employed as carriers for the compositions of this invention. Suitable biodegradable microspheres are shown, for example, in U.S. Pat. Nos. 4,897,268, 5,075,109, 5,928,647, 5,811,128, 5,820,883, 5,853,763, 5,814,344 and 5,942,252. "Compounds" as used herein, include the peptides, amino acid sequences, cargo compounds and complexes of the present invention The compositions of the invention may be sterilized by conventional, well-known sterilization techniques, or may be sterile filtered. The resulting aqueous solutions may be packaged for use as is, or lyophilized, the lyophilized preparation being combined with a sterile solution prior to administration.

The compositions of the invention may be administered in a variety of ways, including by injection (e.g., intradermal, subcutaneous, intramuscular, intraperitoneal and the like), by inhalation, by topical administration, by suppository, by using a transdermal patch or by mouth.

When administration is by injection, composition may be formulated in aqueous solutions, preferably in physiologically compatible buffers such as flanks solution, Ringer's solution, or physiological saline buffer. The solution may contain formulatory agents such as suspending, stabilizing and/or dispersing agents. Alternatively, the composition may be in powder form for constitution with a suitable vehicle, e.g., sterile pyrogen-free water, before use.

When administration is by inhalation, the composition may be delivered in the form of an aerosol spray from pressurized packs or a nebulizer with the use of a suitable propellant, e.g., dichlorodifluoromethane, trichlorofluoromethane, carbon dioxide or other suitable gas. In the case of a pressurized aerosol, the dosage unit may be determined by providing a valve to deliver a metered amount. Capsules and cartridges of, e.g., gelatin for use in an inhaler or insufflator may be formulated containing a powder mix of the proteins and a suitable powder base such as lactose or starch.

When administration is by topical administration, the composition may be formulated as solutions, gels, ointments, creams, suspensions, and the like, as are well known in the art. In some embodiments, administration is by means of a transdermal patch. When administration is by suppository (e.g., rectal or vaginal), composition may also be formulated in compositions containing conventional suppository bases.

When administration is oral, the composition can be readily formulated in combination with pharmaceutically acceptable carriers well known in the art. A solid carrier, such as mannitol, lactose, magnesium stearate, and the like may be employed; such carriers enable the chemotaxis to be formulated as tablets, pills, dragees, capsules, liquids, gels, syrups, slurries, suspensions and the like, for oral ingestion by a subject to be treated. For oral solid formulations such as, for example, powders, capsules and tablets, suitable excipients include fillers such as sugars, cellulose preparation, granulating agents, and binding agents.

Other convenient carriers, as well-known in the art, also include multivalent carriers, such as bacterial capsular polysaccharide, a dextran or a genetically engineered vector. In addition, sustained-release formulations that include the composition allow for the release of the composition over extended periods of time, such that without the sustained release formulation, composition would be cleared from a subject's system, and/or degraded by, for example, proteases and simple hydrolysis before eliciting or enhancing therapeutic effect.

The exact formulation, route of administration, and dosage is typically determined by the attending physician in view of the patient's condition. Dosage amount and interval can be adjusted individually to provide plasma levels of the complex which are sufficient to maintain therapeutic effect. Generally, the desired composition is administered in an admixture with a pharmaceutical carrier selected with regard to the intended route of administration and standard pharmaceutical practice.

The appropriate dosage will, of course, vary depending upon, for example, the compound containing the cupredoxin entry domain employed, the host, the mode of administration and the nature and severity of the conditions being treated or diagnosed. However, in one embodiment of the methods of the present invention, satisfactory treatment results in humans are indicated to be obtained at daily dosages from about 0.001 to about 20 mg/kg of body weight of the compound containing the modified cupredoxin derived peptide. In one embodiment, an indicated daily dosage for treatment in humans may be in the range from about 0.7 mg to about 1400 mg of a compound containing the modified cupredoxin derived peptide conveniently administered, for example, in daily doses, weekly doses, monthly doses, and/or continuous dosing. Daily doses can be in discrete dosages from 1 to 12 times per day. Alternatively, doses can be administered every other day, every third day, every fourth day, every fifth day, every sixth day, every week, and similarly in day increments up to 31 days. Dosing can be continuous, intermittent or a single dose, using any applicable dosing form, including tablet, patches, i.v. administration and the like. More specifically, the composition is administered in a therapeutically effective amount. In specific embodiments, the therapeutically effective amount is from about 0.01-20 mg/kg of body weight. In specific embodiments, the dose level is about 10 mg/kg/day, about 15 mg/kg/day, about 20 mg/kg/day, about 25 mg/kg/day, about 30 mg/kg/day, about 35 mg/kg/day, about 40 mg/kg/day, about 45 mg/kg/day or about 50 mg/kg/day.

The method of introducing compounds containing the modified cupredoxin derived peptide to patients is, in some embodiments, co-administration with other drugs known to treat the condition. Such methods are well-known in the art. In a specific embodiment, the compounds containing the modified cupredoxin derived peptide are part of an cocktail or co-dosing containing or with other drugs for treating cancer, HIV, malaria, inappropriate angiogeniesis, and conditions related to ephrin-signaling. Many other such compounds are known to those skilled in the art and are provided by the patent applications that have been expressly incorporated by reference.

Nucleic acid molecules encoding a cupredoxin derived peptide or a fusion protein combining a cupredoxin derived peptide and a cargo compound can be inserted into vectors and used as gene therapy vectors. Gene therapy vectors can be delivered to a subject by, for example, intravenous injection, local administration (Nabel et al., U.S. Pat. No. 5,328,470), or by stereotactic injection (Chen et al., Proc Natl Acad Sci USA 91:3054-3057 (1994)). The pharmaceutical preparation of a gene therapy vector can include an acceptable diluent or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells that produce the gene delivery system.

In one aspect, the composition is delivered as DNA such that the complex is generated in situ. In one embodiment, the DNA is "naked," as described, for example, in Ulmer et al., Science 259:1745-1749 (1993) and reviewed by Cohen, Science 259 1691-1692 (1993). The uptake of naked DNA may be increased by coating the DNA onto a carrier, e.g. a biodegradable bead, which is efficiently transported into the cells. In such methods, the DNA may be present within any of a variety of delivery systems known to those of ordinary skill in the art, including nucleic acid expression systems, bacterial and viral expression systems. Techniques for incorporating DNA into such expression systems are well known to those of ordinary skill in the art. See, e.g., WO90/11092, WO93/24640, WO 93/17706, and U.S. Pat. No. 5,736,524.

Vectors, used to shuttle genetic material from organism to organism, can be divided into two general classes: Cloning vectors are replicating plasmid or phage with regions that are non-essential for propagation in an appropriate host cell and into which foreign DNA can be inserted; the foreign DNA is replicated and propagated as if it were a component of the vector. An expression vector (such as a plasmid, yeast, or animal virus genome) is used to introduce foreign genetic material into a host cell or tissue in order to transcribe and translate the foreign DNA, such as the DNA of the composition. In expression vectors, the introduced DNA is operably-linked to elements such as promoters that signal to the host cell to transcribe the inserted DNA. Some promoters are exceptionally useful, such as inducible promoters that control gene transcription in response to specific factors. Operably-linking a composition polynucleotide to an inducible promoter can control the expression of a modified cupredoxin derived peptide of the invention. Examples of classic inducible promoters include those that are responsive to α-interferon, heat shock, heavy metal ions, and steroids such as glucocorticoids (Kaufman, Methods Enzymol. 185:487-511 (1990)) and tetracycline. Other desirable inducible promoters include those that are not endogenous to the cells in which the construct is being introduced, but, however, are responsive in those cells when the induction agent is exogenously supplied. In general, useful expression vectors are often plasmids. However, other forms of expression vectors, such as viral vectors (e.g., replication defective retroviruses, adenoviruses and adeno-associated viruses) are contemplated.

Vector choice is dictated by the organism or cells being used and the desired fate of the vector. In general, vectors comprise signal sequences, origins of replication, marker genes, enhancer elements, promoters, and transcription termination sequences.

Kits Comprising a Modified Cupredoxin Derived Peptide

In another aspect, the invention provides kits containing one or more of the following in a package or container: (1) a reagent comprising a modified cupredoxin derived peptide; (2) a reagent containing a pharmaceutically acceptable adjuvant or excipient; (3) a vehicle for administration, such as a syringe; and (4) instructions for administration. Embodiments in which two or more of components (1)-(4) are found in the same container are also contemplated.

When a kit is supplied, the different components of the composition may be packaged in separate containers and admixed immediately before use. Such packaging of the components separately may permit long-term storage without losing the active components' functions.

The reagents included in the kit can be supplied in containers of any sort such that the life of the different components are preserved and are not adsorbed or altered by the materials of the container. For example, sealed glass ampules may contain lyophilized polypeptide or polynucleotide, or buffers that have been packaged under a neutral, non-reacting gas, such as nitrogen. Ampules may consist of any suitable material, such as glass, organic polymers, such as polycarbonate, polystyrene, etc., ceramic, metal or any other material typically employed to hold similar reagents. Other examples of suitable containers include simple bottles that may be fabricated from similar substances as ampules, and envelopes, that may comprise foil-lined interiors, such as aluminum or an alloy. Other containers include test tubes, vials, flasks, bottles, syringes, or the like. Containers may have a sterile access port, such as a bottle having a stopper that can be pierced by a hypodermic injection needle. Other containers may have two compartments that are separated by a readily removable membrane that upon removal permits the components to be mixed. Removable membranes may be glass, plastic, rubber, etc.

Kits may also be supplied with instructional materials. Instructions may be printed on paper or other substrate, and/or may be supplied as an electronic-readable medium, such as a floppy disc, CD-ROM, DVD-ROM, Zip disc, videotape, audiotape, flash memory device, etc. Detailed instructions may not be physically associated with the kit; instead, a user may be directed to an internet web site specified by the manufacturer or distributor of the kit, or supplied as electronic mail.

A more complete understanding of the present invention can be obtained by reference to the following specific Examples. The Examples are described solely for purposes of illustration and are not intended to limit the scope of the invention. Changes in form and substitution of equivalents are contemplated as circumstances may suggest or render expedient. Although specific terms have been employed herein, such terms are intended in a descriptive sense and not for purposes of limitations. Modifications and variations of the invention as hereinbefore set forth can be made without departing from the spirit and scope thereof, and, therefore, only such limitations should be imposed as are indicated by the appended embodiments.

EXAMPLES

Example 1—In Vivo Xenotransplanted Tumor Model and Trafficking Experiments

Imaging studies in athymic mice with Mel-2 xenographs were performed to determine the distribution of p18 (SEQ ID NO: 14) in the body of the mice over time. Female nude mice were injected subcutaneously with $1 \times 10^6$ UISO-Mel-2 cells in the flank. When tumors had grown to the size of 0.5 mm (in one of three diameter measurements), studies were initiated with labeled p18. To label p18, p18 was incubated with IRDye® 800CW NHS Ester Infrared Dye (LI-COR Biosciences, Lincoln, Nebr.) for 2 hrs at 4° C. with continuous stirring. Labeled peptide was separated from unbound dye by dialysis in Slide-A-Lyzer® Dialysis Cassettes for a minimum of 48 hrs against PBS.

125 µg/mouse of IRDye® labeled p18 (SEQ ID NO: 14) in 100 µl sterile PBS (phosphate buffered saline) was injected intravenously, and mice were scanned daily for detection of labeled dye in tumors and organs using the Odyssey® Infrared Imaging System. High resolution scans were taken at a depth of between 1 and 1.5 mm for detection of subcutaneous tumors. Images recorded with the 800 nm channel (green color) represent specific signal and those with the 700 nm channel (red color) represent background.

Figure 2:
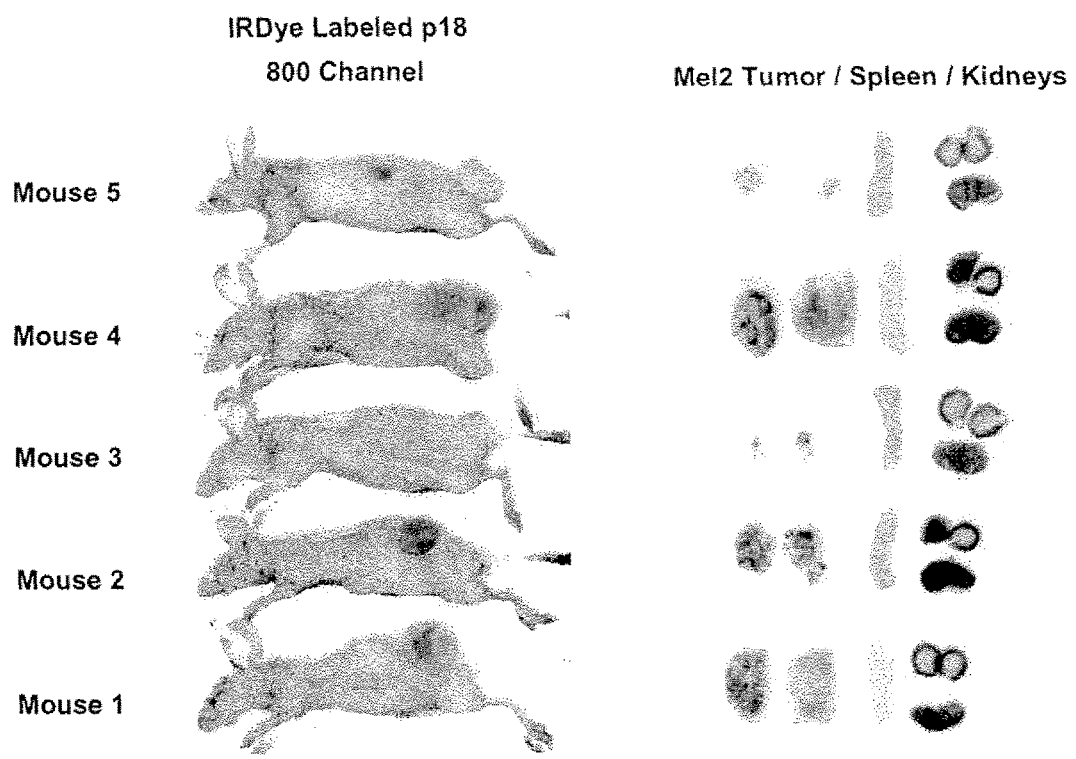
FIG. 2 depicts the images from whole mouse and organs scans of mice that have been injected with labeled p18. 125 µg IRDye® labeled p18 120 h post-injection i.v. (immediately before sacrifice). Excised organs scanned and shown on right. p18 signal was seen from kidneys and Mel-2 tumors.

In the first experiment, mice with 0.5 mm Mel-2 tumors where scanned up to 16 days to determine the localization of the IRDye®. FIG. 1. In the second experiment, mice with 0.5 mm Mel-2 tumors were injected i.v. with 125 µg/mouse of IRDye® labeled p18 and sacrificed 120 hrs later. Whole mouse scans where taken, and organs and tumors were excised and scanned to determine the localization of the IRDye®. High resolution scans of organs and cross sections after excision were taken at a depth of between 0.1 and 0.5 mm. FIG. 2. In the third experiment, mice were injected with Mel-2 cells and the tumors were allowed to develop for three weeks. The mice where then injected with 125 µg/mouse of IRDye® labeled p18, and 48 hours later, sacrificed and scanned to determine the localization of the IRDye®.

Figure 3:
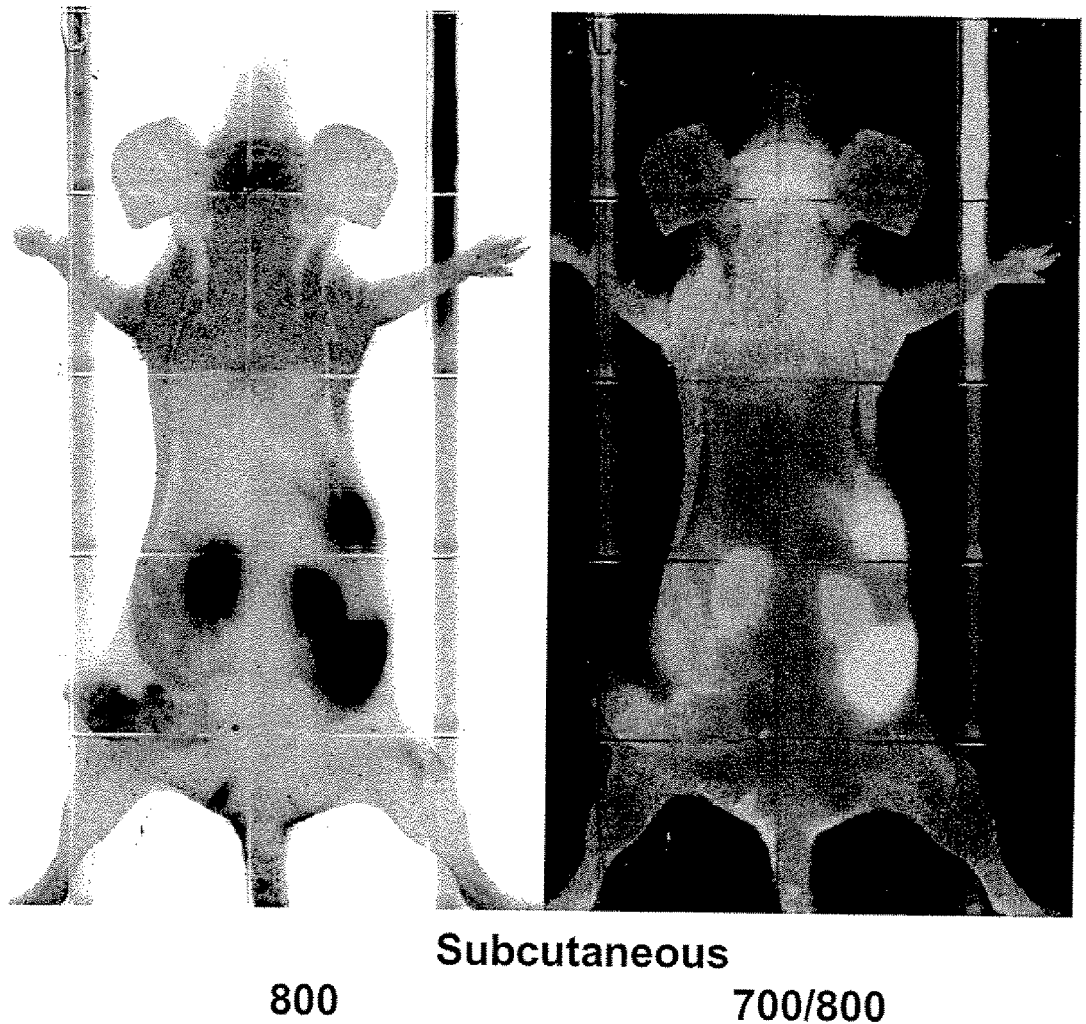
FIG. 3. Mel-2 subcutaneous tumor with 125 µg IRDye® labeled p18 administered i.v. 3 weeks after Mel-2 cells were injected, and Odyssey® infrared scan was performed 48 hours later. Images recorded with the 800 nm channel represent specific p18 signal from IRDye®, and those with the 700 nm channel represent background. p18 signal was seen from kidneys and Mel-2 tumors.

These experiments indicate that IRDye® labeled p18 localizes to the tumor and kidneys as soon as 5 hours after injection into the mouse. See FIG. 1. The kidneys accumulate the IRDye-p18 complex, suggesting that the p18 is removed from the bloodstream of the mouse primarily by excretion through the kidneys. See FIG. 2 and FIG. 3.

Example 2—Treatment of Patients Suffering from Cancer with Modified Cupredoxin Derived Peptides A Phase I/II clinical trial of a PEGylated p28 (SEQ ID NO: 13) fusion (Study Drug) will be performed in patients suffering from cancer. Specifically, p28 from *Pseudomonas aeruginosa* will be modified by PEGylation.

Forty-nine adult patients with histologically verified cancers of the breast, colon and melanoma who demonstrate clinical and radiographic progression or recurrence following adequate treatment by currently available FDA-approved chemotherapeutic drugs and regimen will be enrolled in an open-label prospective study administering the Study Drug. To be eligible for enrollment in the study, all patients demonstrate increasing volume of measurable tumor after completion of approved course of chemotherapy regimens. The evidence of persistent metastatic deposits and/or continued increase in size or volume must be histologically established. This histological proof can be obtained by a fine needle aspiration (FNA) biopsy.

The treatment program will be instituted after obtaining informed consent from all patients in accordance with the Institutional Review Board of the University of Illinois, Chicago and the FDA. The patients will have no intercurrent illness such as other malignancy, history of previous malignancy, blood dyscrasias, insulin dependent diabetes or other serious cardiovascular diseases which might interfere in appropriate evaluation of the effects of the proposed therapy. Baseline blood work (Complete Blood Counts [CBC] and Serum Chemistry) including liver function studies (LFT) will be performed prior to initiation of therapy. All eligible patients must not receive any cancer chemotherapy concurrently during the period of the trial.

The study drug will be administered by daily intravenous injection of a pharmaceutically acceptable preparation of the Study Drug for 12 weeks and the subjects will be observed for any dose limiting toxicity. There will be 7 dose levels starting with 10 mg/kg/day and increasing by 5 mg/kg/day up to a maximum dose of 50 mg/kg/day. The efficacy of each dose level will be recorded in 7 patients with advanced measurable cancer (breast, colon, and melanoma).

The response will be estimated by measuring the measurable tumor in 2 dimensions (a and b). 1) Total disappearance of the target metastatic tumors will be considered as complete response (CR); 2) A 75% reduction will be considered excellent, partial response (PR); and 3) A good response (PR) will be post treatment reduction in size by 50%. 4) Reduction of 25% in size will be considered as stable disease (SD) and 5) <25% will be considered as no response (NR). Patients demonstrating a progression of disease will have their treatment discontinued but will be followed for an additional 12 weeks.

Total disappearance, and any reduction in size of the target metastatic tumors will indicate that the azurin treatment is effective for treating cancer. Other indications that the PEGylated p28 treatment is effective are a decrease rate of in the appearance of new metastatic tumors and a decrease in the angiogenesis associated with tumors.

Various modifications and variations of the described examples and systems of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention which are obvious to those skilled in related fields are intended to be within the scope of the following embodiments.

SEQUENCE LISTING (3505 sequences)

SEQ ID NO: 1 - protein, 128 aa, Pseudomonas aeruginosa
AECSVDIQGNDQMQFNTNAITVDKSCKQFTVNLSHPGNLPKNVMGHNWVLSTAADMQGVVTDGMASGLDKDYLKPDDSRVIAHTKLIGSGEKDSVTFDVSKLKEGEQYMFFCTFPGHSALMKGTLTLK

SEQ ID NO: 2 - protein, 105 aa, Phormidium laminosum
ETFTVKMGADSGLLQFEPANVTVHPGDTVKWVNNKLPPHNILFDDKQVPGASKELADKLSHSQLMFSPGESYEITFSSDFPAGTYTYYCAPHRGAGMVGKITVEG

SEQ ID NO: 3 - protein, 155 aa, Thiobacillus ferrooxidans
GTLDTTWKEATLPQVKAMLEKDTGKVSGDTVTYSGKTVHVVAAAVLPGFPFPSFEVHDKKNPTLEIPAGATVDVTFINTNKGFGHSFDITKKGPPYAVMPVIDPIVAGTGFSPVPKDGKFGYTDFTWHPTAGTYYYVCQIPGHAATGMFGKIVVK

SEQ ID NO: 4 - protein, 124 aa, Achromobacter cycloclastes
ADFEVHMLNKGKDGAMVFEPASLKVAPGDTVTFIPTDKGHNVETIKGMIPDGAEAFKSKINENYKVTFTAPGVYGVKCTPHYGMGMVGVVQVGDAPANLEAVKGAKNPKKAQERLDAALAALGN

SEQ ID NO: 5 - protein, 136 aa, Pseudomonas syringae
MASGQLLAAECSATVDSTDQMMYDTKAIQIDKSCKEFTLNLTHSGSLPKNVMGHNWVLSKKADASAITTDGMSVGIDKDYVKPDDTRVIAHTKIIGAGENDSVTFDVSKLDPAEDYQFFCTFPGHISMMKGAVTLK

SEQ ID NO: 6 - protein, 183 aa, Neisseria gonorrhoeae
MKAYLALISAAVIGLAACSQEPAAPAAEATPAGEAPASEAPAAEAAPADAAEAPAAGNCAATVESNDNMQFNTKDIQVSKACKEFTITLKHTGTQPKASMGHNLVIAKAEDMDGVFKDGVGAADTDYVKPDDARVVAHTKLIGGGEESSLTLDPAKLADGDYKFACTFPGHGALMNGKVTLVD

SEQ ID NO: 7 - protein, 183 aa, Neisseria meningitides
MKAYLALISAAVIGLAACSQEPAAPAAEATPAAEAPASEAPAAEAAPADAAEAPAAGNCAATVESNDNMQFNTKDIQVSKACKEFTITLKHTGTQPKTSMGHNIVIGKTEDMDGIFKDGVGAADTDYVKPDDARVVAHTKLIGGGEESSLTLDPAKLADGEYKFACTFPGHGALMNGKVTLVD

SEQ ID NO: 8 - protein, 150 aa, Vibrio parahaemolyticus
MSLRILAATLALAGLSFGAQASAECEVSIDANDMMQFSTKTLSVPATCKEVTLTLNHTGKMPAQSMGHNVVIADTANIQAVGTDGMSAGADNSYVKPDDERVYAHTKVVGGGESTSITFSTEKMTAGGDYSFFCSFPGHWAIMQGKFEFK

SEQ ID NO: 9 - protein, 129 aa, Bordetella bronchiseptica
AECSVDIAGTDQMQFDKKAIEVSKSCKQFTVNLKHTGKLPRNVMGHNWVLTKTADMQAVEKDGIAAGLDNQYLKAGDTRVLAHTKVLGGGESDSVTFDVAKLAAGDDYTFFCSFPGHGALMKGTLKLVD

SEQ ID NO: 10 - protein, 162 aa, Chloroflexus aurantiacus
MKITLRMMVLAVLTAMAMVLAACGGGGSSGGSTGGGSGSGPVTIEIGSKGEELAFDKTELTVSAGQTVTIRFKNNSAVQQHNWILVKGGEAEAANIANAGLSAGPAANYLPADKSNIIAESPLANGNETVEVTFTAPAAGTYLYICTVPGHYPLMQGKLVVN

SEQ ID NO: 11 - protein, 140 aa, Chloroflexus aurantiacus
AANAPGGSNVVNETPAQTVEVRAAPDALAFAQTSLSLPANTVVRLDFVNQNNLGVQHNWVLVNGGDDVAAAVNTAAQNNADALFVPPPDTPNALAWTAMLNAGESGSVTFRTPAPGTYLYICTFPGHYLAGMKGTLTVTP

SEQ ID NO: 12 - protein, 129 aa, Bordetella pertussis; identical to SEQ ID NO: 9

SEQ ID NO: 13 - protein, 28 aa, Pseudomonas aeruginosa
LSTAADMQGVVTDGMASGLDKDYLKPDD

SEQ ID NO: 14 - protein, 18 aa, Pseudomonas aeruginosa
LSTAADMQGVVTDGMASG

SEQ ID NO: 15 - protein, 93 aa, Pseudomonas aeruginosa
PGNLPKNVMGHNWVLSTAADMQGVVTDGMASGLDKDYLKPDDSRVIAHTKLIGSGEKDSVTFDVSKLKEGEQYMFFCTFPGHSALMKGTLTLK

SEQ ID NO: 16 - protein, 54 aa, Pseudomonas aeruginosa
PGNLPKNVMGHNWVLSTAADMQGVVTDGMASGLDKDYLKPDDSRVIAHTKLIGS

SEQ ID NO: 17 - protein, 42 aa, Pseudomonas aeruginosa
PGNLPKNVMGHNWVLSTAADMQGVVTDGMASGLDKDYLKPDD

SEQ ID NO: 18 - protein, 15 aa, Pseudomonas aeruginosa
PGNLPKNVMGHNWVL

SEQ ID NO: 19 - protein, 17 aa, Pseudomonas aeruginosa
LSTAADMQGVVTDGMAS

SEQ ID NO: 20 - protein, 11 aa, Pseudomonas aeruginosa
GLDKDYLKPDD

SEQ ID NO: 21 - protein, 33 aa, Chloroflexus aurantiacus
HNWVLVNGGDDVAAAVNTAAQNNADALFVPPPD

SEQ ID NO: 22 - protein, 28 aa, Bordetella pertussis
LTKTADMQAVEKDGIAAGLDNQYLKAGD

SEQ ID NO: 23 - protein, 27 aa, Neisseria meningitidis
IAKAEDMDGVFKDGVGAADTDYVKPDD

SEQ ID NO: 24 - protein, 21 aa, Pseudomonas aeruginosa
EAADMQGVVTDGMASGLDKDY

SEQ ID NO: 25 - protein, 15 aa, Pseudomonas aeruginosa
EAADMQGVVTDGMAS

SEQ ID NO: 26 - protein, 27 aa, Pseudomonas aeruginosa
STAADMQGVVTDGMASGLDKDYLKPDD

SEQ ID NO: 27 - protein, 27 aa, Pseudomonas syringae
SKKADASAITTDGMSVGIDKDYVKPDD

SEQ ID NO: 28 - protein, 27 aa, Vibrio parahaemolyticus
ADTANIQAVGTDGMSAGADNSYVKPDD

SEQ ID NO: 29 - protein, 27 aa, Bordetella bronchiseptica
TKTADMQAVEKDGIAAGLDNQYLKAGD

SEQ ID NO: 30 - protein, 28 aa, Pseudomonas aeruginosa
LSTAADMQAVVTDTMASGLDKDYLKPDD

SEQ ID NO: 31 - protein, 28 aa, Pseudomonas aeruginosa
LSTAADLQGVVTDGLASGLDKDYLKPDD

SEQ ID NO: 32 - protein, 28 aa, Pseudomonas aeruginosa
LSTAADVQGVVTDGVASGLDKDYLKPDD

SEQ ID NO: 33 - protein, 28 aa, Pseudomonas aeruginosa
  N-terminus acetylated
  C-terminus amidated
LSTAADMQGVVTDGMASGLDKDYLKPDD

SEQ ID NO: 34 - protein, 28 aa, Pseudomonas aeruginosa
LSWAADMQGVVTDGMASGLDKDYLKPDD

SEQ ID NO: 35 - protein, 28 aa, Pseudomonas aeruginosa
LSTAADMWGVVTDGMASGLDKDYLKPDD

SEQ ID NO: 36 - protein, 28 aa, Pseudomonas aeruginosa
LSTAADMQGVVWDGMASGLDKDYLKPDD

SEQ ID NO: 37 - protein, 28 aa, Pseudomonas aeruginosa
LSTAADMQGVVTDWMASGLDKDYLKPDD

SEQ ID NO: 38 - protein, 28 aa, Pseudomonas aeruginosa
LSWAADMWGVVTDGMASGLDKDYLKPDD

SEQ ID NO: 39 - protein, 28 aa, Pseudomonas aeruginosa
LSWAADMQGVVWDGMASGLDKDYLKPDD

SEQ ID NO: 40 - protein, 28 aa, Pseudomonas aeruginosa
LSWAADMQGVVTDWMASGLDKDYLKPDD

SEQ ID NO: 41 - protein, 28 aa, Pseudomonas aeruginosa
LSTAADMWGVVWDGMASGLDKDYLKPDD

SEQ ID NO: 42 - protein, 28 aa, Pseudomonas aeruginosa
LSTAADMWGVVTDWMASGLDKDYLKPDD

SEQ ID NO: 43 - protein, 28 aa, Pseudomonas aeruginosa
LSTAADMQGVVWDWMASGLDKDYLKPDD

SEQ ID NO: 44 - protein, 28 aa, Pseudomonas aeruginosa
LSWAADMWGVVWDWMASGLDKDYLKPDD

SEQ ID NO: 45 - protein, 28 aa, Pseudomonas aeruginosa
DDPKLYDKDLGSAMGDTVVGQMDAATSL

SEQ ID NO: 46 - protein, 16 aa, Artificial Sequence
  Description of Artificial Sequence: Synthetic peptide
  MOD_RES (3)..(7): Any amino acid
  MOD_RES (9)..(10): Any amino acid
  MOD_RES (12)..(12): Any amino acid
  MOD_RES (14)..(15): Any amino acid
DGXXXXXDXXYXKXXD

SEQ ID NO: 47 - protein, 15 aa, Artificial Sequence
  Description of Artificial Sequence: Synthetic peptide
  MOD_RES (3)..(6): Any amino acid
  MOD_RES (8)..(9): Any amino acid
  MOD_RES (11)..(11): Any amino acid
  MOD_RES (13)..(14): Any amino acid
DGXXXXDXXYXKXXD

SEQ ID NO: 48 - protein, 28 aa, Artificial Sequence
  Description of Artificial Sequence: Synthetic peptide
  N-terminus may or may not be acetylated
  MOD_RES (3)..(3): Thr or Trp
  MOD_RES (7)..(7): Met, Leu, or Val
  MOD_RES (8)..(8): Gln or Trp
  MOD_RES (9)..(9): Gly or Ala
  MOD_RES (12)..(12): Thr or Trp
  MOD_RES (14)..(14): Gly, Thr, or Trp
  MOD_RES (15)..(15): Met, Leu, or Val
  C-terminus may or may not be amidated
LSXAADXXXVVXDXXASGLDKDYLKPDD

SEQ ID NO: 49 - protein, 28 aa, Artificial Sequence
  Description of Artificial Sequence: Synthetic peptide
  N-terminus may or may not be acetylated
  MOD_RES (14)..(14): Met, Leu, or Val
  MOD_RES (15)..(15): Gly, Thr, or Trp
  MOD_RES (17)..(17): Thr or Trp
  MOD_RES (20)..(20): Gly or Ala
  MOD_RES (21)..(21): Gln or Trp
  MOD_RES (22)..(22): Met, Leu, or Val
  MOD_RES (26)..(26): Thr or Trp
  C-terminus may or may not be amidated
DDPKLYDKDLGSAXXDXVVXXXDAAXSL

SEQ ID NO: 50 - protein, 28 aa, Artificial Sequence
  Description of Artificial Sequence: Synthetic peptide
LSTAADMQGVVTDGMASGLDKDYLKPDD

SEQ ID NO: 51 - protein, 28 aa, Artificial Sequence
  Description of Artificial Sequence: Synthetic peptide
  N-terminus acetylated
LSTAADMQGVVTDGMASGLDKDYLKPDD

SEQ ID NO: 52 - protein, 28 aa, Artificial Sequence
  Description of Artificial Sequence: Synthetic peptide
LSWAADMQGVVTDGMASGLDKDYLKPDD

SEQ ID NO: 53 - protein, 28 aa, Artificial Sequence
  Description of Artificial Sequence: Synthetic peptide
  N-terminus acetylated
LSWAADMQGVVTDGMASGLDKDYLKPDD

SEQ ID NO: 54 - protein, 28 aa, Artificial Sequence
  Description of Artificial Sequence: Synthetic peptide
LSTAADLQGVVTDGMASGLDKDYLKPDD

SEQ ID NO: 55 - protein, 28 aa, Artificial Sequence
  Description of Artificial Sequence: Synthetic peptide
  N-terminus acetylated
LSTAADLQGVVTDGMASGLDKDYLKPDD

SEQ ID NO: 56 - protein, 28 aa, Artificial Sequence
  Description of Artificial Sequence: Synthetic peptide
LSWAADLQGVVTDGMASGLDKDYLKPDD

SEQ ID NO: 57 - protein, 28 aa, Artificial Sequence
  Description of Artificial Sequence: Synthetic peptide
  N-terminus acetylated
LSWAADLQGVVTDGMASGLDKDYLKPDD

SEQ ID NO: 58 - protein, 28 aa, Artificial Sequence
  Description of Artificial Sequence: Synthetic peptide
LSTAADVQGVVTDGMASGLDKDYLKPDD

SEQ ID NO: 59 - protein, 28 aa, Artificial Sequence
  Description of Artificial Sequence: Synthetic peptide
  N-terminus acetylated
LSTAADVQGVVTDGMASGLDKDYLKPDD

SEQ ID NO: 60 - protein, 28 aa, Artificial Sequence
  Description of Artificial Sequence: Synthetic peptide
LSWAADVQGVVTDGMASGLDKDYLKPDD

SEQ ID NO: 61 - protein, 28 aa, Artificial Sequence
  Description of Artificial Sequence: Synthetic peptide
  N-terminus acetylated
LSWAADVQGVVTDGMASGLDKDYLKPDD

SEQ ID NO: 62 - protein, 28 aa, Artificial Sequence
  Description of Artificial Sequence: Synthetic peptide
LSTAADMWGVVTDGMASGLDKDYLKPDD

SEQ ID NO: 63 - protein, 28 aa, Artificial Sequence
  Description of Artificial Sequence: Synthetic peptide
  N-terminus acetylated
LSTAADMWGVVTDGMASGLDKDYLKPDD

SEQ ID NO: 64 - protein, 28 aa, Artificial Sequence
  Description of Artificial Sequence: Synthetic peptide
LSWAADMWGVVTDGMASGLDKDYLKPDD

SEQ ID NO: 65 - protein, 28 aa, Artificial Sequence
  Description of Artificial Sequence: Synthetic peptide
  N-terminus acetylated
LSWAADMWGVVTDGMASGLDKDYLKPDD

SEQ ID NO: 66 - protein, 28 aa, Artificial Sequence
  Description of Artificial Sequence: Synthetic peptide
LSTAADLWGVVTDGMASGLDKDYLKPDD

SEQ ID NO: 67 - protein, 28 aa, Artificial Sequence
  Description of Artificial Sequence: Synthetic peptide
  N-terminus acetylated
LSTAADLWGVVTDGMASGLDKDYLKPDD

SEQ ID NO: 68 - protein, 28 aa, Artificial Sequence
  Description of Artificial Sequence: Synthetic peptide
LSWAADLWGVVTDGMASGLDKDYLKPDD

SEQ ID NO: 69 - protein, 28 aa, Artificial Sequence
  Description of Artificial Sequence: Synthetic peptide
  N-terminus acetylated
LSWAADLWGVVTDGMASGLDKDYLKPDD

SEQ ID NO: 70 - protein, 28 aa, Artificial Sequence
  Description of Artificial Sequence: Synthetic peptide
LSTAADVWGVVTDGMASGLDKDYLKPDD

SEQ ID NO: 71 - protein, 28 aa, Artificial Sequence
  Description of Artificial Sequence: Synthetic peptide
  N-terminus acetylated
LSTAADVWGVVTDGMASGLDKDYLKPDD

SEQ ID NO: 72 - protein, 28 aa, Artificial Sequence
  Description of Artificial Sequence: Synthetic peptide
LSWAADVWGVVTDGMASGLDKDYLKPDD

SEQ ID NO: 73 - protein, 28 aa, Artificial Sequence
  Description of Artificial Sequence: Synthetic peptide
  N-terminus acetylated
LSWAADVWGVVTDGMASGLDKDYLKPDD

SEQ ID NO: 74 - protein, 28 aa, Artificial Sequence
  Description of Artificial Sequence: Synthetic peptide
LSTAADMQAVVTDGMASGLDKDYLKPDD

SEQ ID NO: 75 - protein, 28 aa, Artificial Sequence
  Description of Artificial Sequence: Synthetic peptide
  N-terminus acetylated
LSTAADMQAVVTDGMASGLDKDYLKPDD

SEQ ID NO: 76 - protein, 28 aa, Artificial Sequence
  Description of Artificial Sequence: Synthetic peptide
LSWAADMQAVVTDGMASGLDKDYLKPDD

SEQ ID NO: 77 - protein, 28 aa, Artificial Sequence
  Description of Artificial Sequence: Synthetic peptide
  N-terminus acetylated
LSWAADMQAVVTDGMASGLDKDYLKPDD

SEQ ID NO: 78 - protein, 28 aa, Artificial Sequence
  Description of Artificial Sequence: Synthetic peptide
LSTAADLQAVVTDGMASGLDKDYLKPDD

SEQ ID NO: 79 - protein, 28 aa, Artificial Sequence
  Description of Artificial Sequence: Synthetic peptide
  N-terminus acetylated
LSTAADLQAVVTDGMASGLDKDYLKPDD

SEQ ID NO: 80 - protein, 28 aa, Artificial Sequence
  Description of Artificial Sequence: Synthetic peptide
LSWAADLQAVVTDGMASGLDKDYLKPDD

SEQ ID NO: 81 - protein, 28 aa, Artificial Sequence
  Description of Artificial Sequence: Synthetic peptide
  N-terminus acetylated
LSWAADLQAVVTDGMASGLDKDYLKPDD

SEQ ID NO: 82 - protein, 28 aa, Artificial Sequence
  Description of Artificial Sequence: Synthetic peptide
LSTAADVQAVVTDGMASGLDKDYLKPDD

SEQ ID NO: 83 - protein, 28 aa, Artificial Sequence
  Description of Artificial Sequence: Synthetic peptide
  N-terminus acetylated
LSTAADVQAVVTDGMASGLDKDYLKPDD

SEQ ID NO: 84 - protein, 28 aa, Artificial Sequence
  Description of Artificial Sequence: Synthetic peptide
LSWAADVQAVVTDGMASGLDKDYLKPDD

SEQ ID NO: 85 - protein, 28 aa, Artificial Sequence
  Description of Artificial Sequence: Synthetic peptide
  N-terminus acetylated
LSWAADVQAVVTDGMASGLDKDYLKPDD

SEQ ID NO: 86 - protein, 28 aa, Artificial Sequence
  Description of Artificial Sequence: Synthetic peptide
LSTAADMWAVVTDGMASGLDKDYLKPDD

SEQ ID NO: 87 - protein, 28 aa, Artificial Sequence
  Description of Artificial Sequence: Synthetic peptide
  N-terminus acetylated
LSTAADMWAVVTDGMASGLDKDYLKPDD

SEQ ID NO: 88 - protein, 28 aa, Artificial Sequence
  Description of Artificial Sequence: Synthetic peptide
LSWAADMWAVVTDGMASGLDKDYLKPDD

SEQ ID NO: 89 - protein, 28 aa, Artificial Sequence
  Description of Artificial Sequence: Synthetic peptide
  N-terminus acetylated
LSWAADMWAVVTDGMASGLDKDYLKPDD

SEQ ID NO: 90 - protein, 28 aa, Artificial Sequence
  Description of Artificial Sequence: Synthetic peptide
LSTAADLWAVVTDGMASGLDKDYLKPDD

SEQ ID NO: 91 - protein, 28 aa, Artificial Sequence
  Description of Artificial Sequence: Synthetic peptide
  N-terminus acetylated
LSTAADLWAVVTDGMASGLDKDYLKPDD

SEQ ID NO: 92 - protein, 28 aa, Artificial Sequence
  Description of Artificial Sequence: Synthetic peptide
LSWAADLWAVVTDGMASGLDKDYLKPDD

SEQ ID NO: 93 - protein, 28 aa, Artificial Sequence
  Description of Artificial Sequence: Synthetic peptide
  N-terminus acetylated
LSWAADLWAVVTDGMASGLDKDYLKPDD

SEQ ID NO: 94 - protein, 28 aa, Artificial Sequence
  Description of Artificial Sequence: Synthetic peptide
LSTAADVWAVVTDGMASGLDKDYLKPDD

SEQ ID NO: 95 - protein, 28 aa, Artificial Sequence
  Description of Artificial Sequence: Synthetic peptide
  N-terminus acetylated
LSTAADVWAVVTDGMASGLDKDYLKPDD

SEQ ID NO: 96 - protein, 28 aa, Artificial Sequence
  Description of Artificial Sequence: Synthetic peptide
LSWAADVWAVVTDGMASGLDKDYLKPDD

SEQ ID NO: 97 - protein, 28 aa, Artificial Sequence
  Description of Artificial Sequence: Synthetic peptide
  N-terminus acetylated
LSWAADVWAVVTDGMASGLDKDYLKPDD

SEQ ID NO: 98 - protein, 28 aa, Artificial Sequence
  Description of Artificial Sequence: Synthetic peptide
LSTAADMQGVVWDGMASGLDKDYLKPDD

SEQ ID NO: 99 - protein, 28 aa, Artificial Sequence
  Description of Artificial Sequence: Synthetic peptide
  N-terminus acetylated
LSTAADMQGVVWDGMASGLDKDYLKPDD

SEQ ID NO: 100 - protein, 28 aa, Artificial Sequence
  Description of Artificial Sequence: Synthetic peptide
LSWAADMQGVVWDGMASGLDKDYLKPDD

SEQ ID NO: 101 - protein, 28 aa, Artificial Sequence
  Description of Artificial Sequence: Synthetic peptide
  N-terminus acetylated
LSWAADMQGVVWDGMASGLDKDYLKPDD

SEQ ID NO: 102 - protein, 28 aa, Artificial Sequence
  Description of Artificial Sequence: Synthetic peptide
LSTAADLQGVVWDGMASGLDKDYLKPDD

SEQ ID NO: 103 - protein, 28 aa, Artificial Sequence
  Description of Artificial Sequence: Synthetic peptide
  N-terminus acetylated
LSTAADLQGVVWDGMASGLDKDYLKPDD

SEQ ID NO: 104 - protein, 28 aa, Artificial Sequence
  Description of Artificial Sequence: Synthetic peptide
LSWAADLQGVVWDGMASGLDKDYLKPDD

SEQ ID NO: 105 - protein, 28 aa, Artificial Sequence
  Description of Artificial Sequence: Synthetic peptide
  N-terminus acetylated
LSWAADLQGVVWDGMASGLDKDYLKPDD

SEQ ID NO: 106 - protein, 28 aa, Artificial Sequence
  Description of Artificial Sequence: Synthetic peptide
LSTAADVQGVVWDGMASGLDKDYLKPDD

SEQ ID NO: 107 - protein, 28 aa, Artificial Sequence
  Description of Artificial Sequence: Synthetic peptide
  N-terminus acetylated
LSTAADVQGVVWDGMASGLDKDYLKPDD

SEQ ID NO: 108 - protein, 28 aa, Artificial Sequence
  Description of Artificial Sequence: Synthetic peptide
LSWAADVQGVVWDGMASGLDKDYLKPDD

SEQ ID NO: 109 - protein, 28 aa, Artificial Sequence
  Description of Artificial Sequence: Synthetic peptide
  N-terminus acetylated
LSWAADVQGVVWDGMASGLDKDYLKPDD

SEQ ID NO: 110 - protein, 28 aa, Artificial Sequence
  Description of Artificial Sequence: Synthetic peptide
LSTAADMWGVVWDGMASGLDKDYLKPDD

SEQ ID NO: 111 - protein, 28 aa, Artificial Sequence
  Description of Artificial Sequence: Synthetic peptide
  N-terminus acetylated
LSTAADMWGVVWDGMASGLDKDYLKPDD

SEQ ID NO: 112 - protein, 28 aa, Artificial Sequence
  Description of Artificial Sequence: Synthetic peptide
LSWAADMWGVVWDGMASGLDKDYLKPDD

SEQ ID NO: 113 - protein, 28 aa, Artificial Sequence
  Description of Artificial Sequence: Synthetic peptide
  N-terminus acetylated
LSWAADMWGVVWDGMASGLDKDYLKPDD

SEQ ID NO: 114 - protein, 28 aa, Artificial Sequence
  Description of Artificial Sequence: Synthetic peptide
LSTAADLWGVVWDGMASGLDKDYLKPDD

SEQ ID NO: 115 - protein, 28 aa, Artificial Sequence
  Description of Artificial Sequence: Synthetic peptide
  N-terminus acetylated
LSTAADLWGVVWDGMASGLDKDYLKPDD

SEQ ID NO: 116 - protein, 28 aa, Artificial Sequence
  Description of Artificial Sequence: Synthetic peptide
LSWAADLWGVVWDGMASGLDKDYLKPDD

SEQ ID NO: 117 - protein, 28 aa, Artificial Sequence
  Description of Artificial Sequence: Synthetic peptide
  N-terminus acetylated
LSWAADLWGVVWDGMASGLDKDYLKPDD

SEQ ID NO: 118 - protein, 28 aa, Artificial Sequence
  Description of Artificial Sequence: Synthetic peptide
LSTAADVWGVVWDGMASGLDKDYLKPDD

SEQ ID NO: 119 - protein, 28 aa, Artificial Sequence
  Description of Artificial Sequence: Synthetic peptide
  N-terminus acetylated
LSTAADVWGVVWDGMASGLDKDYLKPDD

SEQ ID NO: 120 - protein, 28 aa, Artificial Sequence
  Description of Artificial Sequence: Synthetic peptide
LSWAADVWGVVWDGMASGLDKDYLKPDD

SEQ ID NO: 121 - protein, 28 aa, Artificial Sequence
  Description of Artificial Sequence: Synthetic peptide
  N-terminus acetylated
LSWAADVWGVVWDGMASGLDKDYLKPDD

SEQ ID NO: 122 - protein, 28 aa, Artificial Sequence
  Description of Artificial Sequence: Synthetic peptide
LSTAADMQAVVWDGMASGLDKDYLKPDD

SEQ ID NO: 123 - protein, 28 aa, Artificial Sequence
  Description of Artificial Sequence: Synthetic peptide
  N-terminus acetylated
LSTAADMQAVVWDGMASGLDKDYLKPDD

SEQ ID NO: 124 - protein, 28 aa, Artificial Sequence
  Description of Artificial Sequence: Synthetic peptide
LSWAADMQAVVWDGMASGLDKDYLKPDD

SEQ ID NO: 125 - protein, 28 aa, Artificial Sequence
  Description of Artificial Sequence: Synthetic peptide
  N-terminus acetylated
LSWAADMQAVVWDGMASGLDKDYLKPDD

SEQ ID NO: 126 - protein, 28 aa, Artificial Sequence
  Description of Artificial Sequence: Synthetic peptide
LSTAADLQAVVWDGMASGLDKDYLKPDD

SEQ ID NO: 127 - protein, 28 aa, Artificial Sequence
  Description of Artificial Sequence: Synthetic peptide
  N-terminus acetylated
LSTAADLQAVVWDGMASGLDKDYLKPDD

SEQ ID NO: 128 - protein, 28 aa, Artificial Sequence
  Description of Artificial Sequence: Synthetic peptide
LSWAADLQAVVWDGMASGLDKDYLKPDD

SEQ ID NO: 129 - protein, 28 aa, Artificial Sequence
  Description of Artificial Sequence: Synthetic peptide
  N-terminus acetylated
LSWAADLQAVVWDGMASGLDKDYLKPDD

SEQ ID NO: 130 - protein, 28 aa, Artificial Sequence
  Description of Artificial Sequence: Synthetic peptide
LSTAADVQAVVWDGMASGLDKDYLKPDD

SEQ ID NO: 131 - protein, 28 aa, Artificial Sequence
  Description of Artificial Sequence: Synthetic peptide
  N-terminus acetylated
LSTAADVQAVVWDGMASGLDKDYLKPDD

SEQ ID NO: 132 - protein, 28 aa, Artificial Sequence
  Description of Artificial Sequence: Synthetic peptide
LSWAADVQAVVWDGMASGLDKDYLKPDD

SEQ ID NO: 133 - protein, 28 aa, Artificial Sequence
  Description of Artificial Sequence: Synthetic peptide
  N-terminus acetylated
LSWAADVQAVVWDGMASGLDKDYLKPDD

SEQ ID NO: 134 - protein, 28 aa, Artificial Sequence
  Description of Artificial Sequence: Synthetic peptide
LSTAADMWAVVWDGMASGLDKDYLKPDD

SEQ ID NO: 135 - protein, 28 aa, Artificial Sequence
  Description of Artificial Sequence: Synthetic peptide
  N-terminus acetylated
LSTAADMWAVVWDGMASGLDKDYLKPDD

SEQ ID NO: 136 - protein, 28 aa, Artificial Sequence
  Description of Artificial Sequence: Synthetic peptide
LSWAADMWAVVWDGMASGLDKDYLKPDD

SEQ ID NO: 137 - protein, 28 aa, Artificial Sequence
  Description of Artificial Sequence: Synthetic peptide
  N-terminus acetylated
LSWAADMWAVVWDGMASGLDKDYLKPDD

SEQ ID NO: 138 - protein, 28 aa, Artificial Sequence
  Description of Artificial Sequence: Synthetic peptide
LSTAADLWAVVWDGMASGLDKDYLKPDD

SEQ ID NO: 139 - protein, 28 aa, Artificial Sequence
  Description of Artificial Sequence: Synthetic peptide
  N-terminus acetylated
LSTAADLWAVVWDGMASGLDKDYLKPDD

SEQ ID NO: 140 - protein, 28 aa, Artificial Sequence
  Description of Artificial Sequence: Synthetic peptide
LSWAADLWAVVWDGMASGLDKDYLKPDD

SEQ ID NO: 141 - protein, 28 aa, Artificial Sequence
  Description of Artificial Sequence: Synthetic peptide
  N-terminus acetylated
LSWAADLWAVVWDGMASGLDKDYLKPDD

SEQ ID NO: 142 - protein, 28 aa, Artificial Sequence
  Description of Artificial Sequence: Synthetic peptide
LSTAADVWAVVWDGMASGLDKDYLKPDD

SEQ ID NO: 143 - protein, 28 aa, Artificial Sequence
  Description of Artificial Sequence: Synthetic peptide
  N-terminus acetylated
LSTAADVWAVVWDGMASGLDKDYLKPDD

SEQ ID NO: 144 - protein, 28 aa, Artificial Sequence
  Description of Artificial Sequence: Synthetic peptide
LSWAADVWAVVWDGMASGLDKDYLKPDD

SEQ ID NO: 145 - protein, 28 aa, Artificial Sequence
  Description of Artificial Sequence: Synthetic peptide
  N-terminus acetylated
LSWAADVWAVVWDGMASGLDKDYLKPDD

SEQ ID NO: 146 - protein, 28 aa, Artificial Sequence
  Description of Artificial Sequence: Synthetic peptide
LSTAADMQGVVTDTMASGLDKDYLKPDD

SEQ ID NO: 147 - protein, 28 aa, Artificial Sequence
  Description of Artificial Sequence: Synthetic peptide
  N-terminus acetylated
LSTAADMQGVVTDTMASGLDKDYLKPDD

SEQ ID NO: 148 - protein, 28 aa, Artificial Sequence
  Description of Artificial Sequence: Synthetic peptide
LSWAADMQGVVTDTMASGLDKDYLKPDD

SEQ ID NO: 149 - protein, 28 aa, Artificial Sequence
  Description of Artificial Sequence: Synthetic peptide
  N-terminus acetylated
LSWAADMQGVVTDTMASGLDKDYLKPDD

SEQ ID NO: 150 - protein, 28 aa, Artificial Sequence
  Description of Artificial Sequence: Synthetic peptide
LSTAADLQGVVTDTMASGLDKDYLKPDD

SEQ ID NO: 151 - protein, 28 aa, Artificial Sequence
  Description of Artificial Sequence: Synthetic peptide
  N-terminus acetylated
LSTAADLQGVVTDTMASGLDKDYLKPDD

SEQ ID NO: 152 - protein, 28 aa, Artificial Sequence
  Description of Artificial Sequence: Synthetic peptide
LSWAADLQGVVTDTMASGLDKDYLKPDD

SEQ ID NO: 153 - protein, 28 aa, Artificial Sequence
  Description of Artificial Sequence: Synthetic peptide
  N-terminus acetylated
LSWAADLQGVVTDTMASGLDKDYLKPDD

SEQ ID NO: 154 - protein, 28 aa, Artificial Sequence
  Description of Artificial Sequence: Synthetic peptide
LSTAADVQGVVTDTMASGLDKDYLKPDD

SEQ ID NO: 155 - protein, 28 aa, Artificial Sequence
  Description of Artificial Sequence: Synthetic peptide
  N-terminus acetylated
LSTAADVQGVVTDTMASGLDKDYLKPDD

SEQ ID NO: 156 - protein, 28 aa, Artificial Sequence
  Description of Artificial Sequence: Synthetic peptide
LSWAADVQGVVTDTMASGLDKDYLKPDD

SEQ ID NO: 157 - protein, 28 aa, Artificial Sequence
  Description of Artificial Sequence: Synthetic peptide
  N-terminus acetylated
LSWAADVQGVVTDTMASGLDKDYLKPDD

SEQ ID NO: 158 - protein, 28 aa, Artificial Sequence
  Description of Artificial Sequence: Synthetic peptide
LSTAADMWGVVTDTMASGLDKDYLKPDD

SEQ ID NO: 159 - protein, 28 aa, Artificial Sequence
  Description of Artificial Sequence: Synthetic peptide
  N-terminus acetylated
LSTAADMWGVVTDTMASGLDKDYLKPDD

SEQ ID NO: 160 - protein, 28 aa, Artificial Sequence
  Description of Artificial Sequence: Synthetic peptide
LSWAADMWGVVTDTMASGLDKDYLKPDD

SEQ ID NO: 161 - protein, 28 aa, Artificial Sequence
  Description of Artificial Sequence: Synthetic peptide
  N-terminus acetylated
LSWAADMWGVVTDTMASGLDKDYLKPDD

SEQ ID NO: 162 - protein, 28 aa, Artificial Sequence
  Description of Artificial Sequence: Synthetic peptide
LSTAADLWGVVTDTMASGLDKDYLKPDD

SEQ ID NO: 163 - protein, 28 aa, Artificial Sequence
  Description of Artificial Sequence: Synthetic peptide
  N-terminus acetylated
LSTAADLWGVVTDTMASGLDKDYLKPDD

SEQ ID NO: 164 - protein, 28 aa, Artificial Sequence
  Description of Artificial Sequence: Synthetic peptide
LSWAADLWGVVTDTMASGLDKDYLKPDD

SEQ ID NO: 165 - protein, 28 aa, Artificial Sequence
  Description of Artificial Sequence: Synthetic peptide
  N-terminus acetylated
LSWAADLWGVVTDTMASGLDKDYLKPDD

SEQ ID NO: 166 - protein, 28 aa, Artificial Sequence
  Description of Artificial Sequence: Synthetic peptide
LSTAADVWGVVTDTMASGLDKDYLKPDD

SEQ ID NO: 167 - protein, 28 aa, Artificial Sequence
  Description of Artificial Sequence: Synthetic peptide
  N-terminus acetylated
LSTAADVWGVVTDTMASGLDKDYLKPDD

SEQ ID NO: 168 - protein, 28 aa, Artificial Sequence
  Description of Artificial Sequence: Synthetic peptide
LSWAADVWGVVTDTMASGLDKDYLKPDD

SEQ ID NO: 169 - protein, 28 aa, Artificial Sequence
  Description of Artificial Sequence: Synthetic peptide
  N-terminus acetylated
LSWAADVWGVVTDTMASGLDKDYLKPDD

SEQ ID NO: 170 - protein, 28 aa, Artificial Sequence
  Description of Artificial Sequence: Synthetic peptide
LSTAADMQAVVTDTMASGLDKDYLKPDD

SEQ ID NO: 171 - protein, 28 aa, Artificial Sequence
  Description of Artificial Sequence: Synthetic peptide
  N-terminus acetylated
LSTAADMQAVVTDTMASGLDKDYLKPDD

SEQ ID NO: 172 - protein, 28 aa, Artificial Sequence
  Description of Artificial Sequence: Synthetic peptide
LSWAADMQAVVTDTMASGLDKDYLKPDD

SEQ ID NO: 173 - protein, 28 aa, Artificial Sequence
  Description of Artificial Sequence: Synthetic peptide
  N-terminus acetylated
LSWAADMQAVVTDTMASGLDKDYLKPDD

SEQ ID NO: 174 - protein, 28 aa, Artificial Sequence
  Description of Artificial Sequence: Synthetic peptide
LSTAADLQAVVTDTMASGLDKDYLKPDD

SEQ ID NO: 175 - protein, 28 aa, Artificial Sequence
  Description of Artificial Sequence: Synthetic peptide
  N-terminus acetylated
LSTAADLQAVVTDTMASGLDKDYLKPDD

SEQ ID NO: 176 - protein, 28 aa, Artificial Sequence
  Description of Artificial Sequence: Synthetic peptide
LSWAADLQAVVTDTMASGLDKDYLKPDD

SEQ ID NO: 177 - protein, 28 aa, Artificial Sequence
  Description of Artificial Sequence: Synthetic peptide
  N-terminus acetylated
LSWAADLQAVVTDTMASGLDKDYLKPDD

SEQ ID NO: 178 - protein, 28 aa, Artificial Sequence
  Description of Artificial Sequence: Synthetic peptide
LSTAADVQAVVTDTMASGLDKDYLKPDD

SEQ ID NO: 179 - protein, 28 aa, Artificial Sequence
  Description of Artificial Sequence: Synthetic peptide
  N-terminus acetylated
LSTAADVQAVVTDTMASGLDKDYLKPDD

SEQ ID NO: 180 - protein, 28 aa, Artificial Sequence
  Description of Artificial Sequence: Synthetic peptide
LSWAADVQAVVTDTMASGLDKDYLKPDD

SEQ ID NO: 181 - protein, 28 aa, Artificial Sequence
  Description of Artificial Sequence: Synthetic peptide
  N-terminus acetylated
LSWAADVQAVVTDTMASGLDKDYLKPDD

SEQ ID NO: 182 - protein, 28 aa, Artificial Sequence
  Description of Artificial Sequence: Synthetic peptide
LSTAADMWAVVTDTMASGLDKDYLKPDD

SEQ ID NO: 183 - protein, 28 aa, Artificial Sequence
  Description of Artificial Sequence: Synthetic peptide
  N-terminus acetylated
LSTAADMWAVVTDTMASGLDKDYLKPDD

SEQ ID NO: 184 - protein, 28 aa, Artificial Sequence
  Description of Artificial Sequence: Synthetic peptide
LSWAADMWAVVTDTMASGLDKDYLKPDD

SEQ ID NO: 185 - protein, 28 aa, Artificial Sequence
  Description of Artificial Sequence: Synthetic peptide
  N-terminus acetylated
LSWAADMWAVVTDTMASGLDKDYLKPDD

SEQ ID NO: 186 - protein, 28 aa, Artificial Sequence
  Description of Artificial Sequence: Synthetic peptide
LSTAADLWAVVTDTMASGLDKDYLKPDD

SEQ ID NO: 187 - protein, 28 aa, Artificial Sequence
  Description of Artificial Sequence: Synthetic peptide
  N-terminus acetylated
LSTAADLWAVVTDTMASGLDKDYLKPDD

SEQ ID NO: 188 - protein, 28 aa, Artificial Sequence
  Description of Artificial Sequence: Synthetic peptide
LSWAADLWAVVTDTMASGLDKDYLKPDD

SEQ ID NO: 189 - protein, 28 aa, Artificial Sequence
  Description of Artificial Sequence: Synthetic peptide
  N-terminus acetylated
LSWAADLWAVVTDTMASGLDKDYLKPDD

SEQ ID NO: 190 - protein, 28 aa, Artificial Sequence
  Description of Artificial Sequence: Synthetic peptide
LSTAADVWAVVTDTMASGLDKDYLKPDD

SEQ ID NO: 191 - protein, 28 aa, Artificial Sequence
  Description of Artificial Sequence: Synthetic peptide
  N-terminus acetylated
LSTAADVWAVVTDTMASGLDKDYLKPDD

SEQ ID NO: 192 - protein, 28 aa, Artificial Sequence
  Description of Artificial Sequence: Synthetic peptide
LSWAADVWAVVTDTMASGLDKDYLKPDD

SEQ ID NO: 193 - protein, 28 aa, Artificial Sequence
  Description of Artificial Sequence: Synthetic peptide
  N-terminus acetylated
LSWAADVWAVVTDTMASGLDKDYLKPDD

SEQ ID NO: 194 - protein, 28 aa, Artificial Sequence
  Description of Artificial Sequence: Synthetic peptide
LSTAADMQGVVWDTMASGLDKDYLKPDD

SEQ ID NO: 195 - protein, 28 aa, Artificial Sequence
  Description of Artificial Sequence: Synthetic peptide
  N-terminus acetylated
LSTAADMQGVVWDTMASGLDKDYLKPDD

SEQ ID NO: 196 - protein, 28 aa, Artificial Sequence
  Description of Artificial Sequence: Synthetic peptide
LSWAADMQGVVWDTMASGLDKDYLKPDD

SEQ ID NO: 197 - protein, 28 aa, Artificial Sequence
  Description of Artificial Sequence: Synthetic peptide
  N-terminus acetylated
LSWAADMQGVVWDTMASGLDKDYLKPDD

SEQ ID NO: 198 - protein, 28 aa, Artificial Sequence
  Description of Artificial Sequence: Synthetic peptide
LSTAADLQGVVWDTMASGLDKDYLKPDD

SEQ ID NO: 199 - protein, 28 aa, Artificial Sequence
  Description of Artificial Sequence: Synthetic peptide
  N-terminus acetylated
LSTAADLQGVVWDTMASGLDKDYLKPDD

SEQ ID NO: 200 - protein, 28 aa, Artificial Sequence
  Description of Artificial Sequence: Synthetic peptide
LSWAADLQGVVWDTMASGLDKDYLKPDD

SEQ ID NO: 201 - protein, 28 aa, Artificial Sequence
  Description of Artificial Sequence: Synthetic peptide
  N-terminus acetylated
LSWAADLQGVVWDTMASGLDKDYLKPDD

SEQ ID NO: 202 - protein, 28 aa, Artificial Sequence
  Description of Artificial Sequence: Synthetic peptide
LSTAADVQGVVWDTMASGLDKDYLKPDD

SEQ ID NO: 203 - protein, 28 aa, Artificial Sequence
  Description of Artificial Sequence: Synthetic peptide
  N-terminus acetylated
LSTAADVQGVVWDTMASGLDKDYLKPDD

SEQ ID NO: 204 - protein, 28 aa, Artificial Sequence
  Description of Artificial Sequence: Synthetic peptide
LSWAADVQGVVWDTMASGLDKDYLKPDD

SEQ ID NO: 205 - protein, 28 aa, Artificial Sequence
  Description of Artificial Sequence: Synthetic peptide
  N-terminus acetylated
LSWAADVQGVVWDTMASGLDKDYLKPDD

SEQ ID NO: 206 - protein, 28 aa, Artificial Sequence
  Description of Artificial Sequence: Synthetic peptide
LSTAADMWGVVWDTMASGLDKDYLKPDD

SEQ ID NO: 207 - protein, 28 aa, Artificial Sequence
  Description of Artificial Sequence: Synthetic peptide
  N-terminus acetylated
LSTAADMWGVVWDTMASGLDKDYLKPDD

SEQ ID NO: 208 - protein, 28 aa, Artificial Sequence
  Description of Artificial Sequence: Synthetic peptide
LSWAADMWGVVWDTMASGLDKDYLKPDD

SEQ ID NO: 209 - protein, 28 aa, Artificial Sequence
  Description of Artificial Sequence: Synthetic peptide
  N-terminus acetylated
LSWAADMWGVVWDTMASGLDKDYLKPDD

SEQ ID NO: 210 - protein, 28 aa, Artificial Sequence
  Description of Artificial Sequence: Synthetic peptide
LSTAADLWGVVWDTMASGLDKDYLKPDD

SEQ ID NO: 211 - protein, 28 aa, Artificial Sequence
  Description of Artificial Sequence: Synthetic peptide
  N-terminus acetylated
LSTAADLWGVVWDTMASGLDKDYLKPDD

SEQ ID NO: 212 - protein, 28 aa, Artificial Sequence
  Description of Artificial Sequence: Synthetic peptide
LSWAADLWGVVWDTMASGLDKDYLKPDD

SEQ ID NO: 213 - protein, 28 aa, Artificial Sequence
  Description of Artificial Sequence: Synthetic peptide
  N-terminus acetylated
LSWAADLWGVVWDTMASGLDKDYLKPDD

SEQ ID NO: 214 - protein, 28 aa, Artificial Sequence
  Description of Artificial Sequence: Synthetic peptide
LSTAADVWGVVWDTMASGLDKDYLKPDD

SEQ ID NO: 215 - protein, 28 aa, Artificial Sequence
  Description of Artificial Sequence: Synthetic peptide
  N-terminus acetylated
LSTAADVWGVVWDTMASGLDKDYLKPDD

SEQ ID NO: 216 - protein, 28 aa, Artificial Sequence
  Description of Artificial Sequence: Synthetic peptide
LSWAADVWGVVWDTMASGLDKDYLKPDD

SEQ ID NO: 217 - protein, 28 aa, Artificial Sequence
  Description of Artificial Sequence: Synthetic peptide
  N-terminus acetylated
LSWAADVWGVVWDTMASGLDKDYLKPDD

SEQ ID NO: 218 - protein, 28 aa, Artificial Sequence
  Description of Artificial Sequence: Synthetic peptide
LSTAADMQAVVWDTMASGLDKDYLKPDD

SEQ ID NO: 219 - protein, 28 aa, Artificial Sequence
  Description of Artificial Sequence: Synthetic peptide
  N-terminus acetylated
LSTAADMQAVVWDTMASGLDKDYLKPDD

SEQ ID NO: 220 - protein, 28 aa, Artificial Sequence
  Description of Artificial Sequence: Synthetic peptide
LSWAADMQAVVWDTMASGLDKDYLKPDD

SEQ ID NO: 221 - protein, 28 aa, Artificial Sequence
  Description of Artificial Sequence: Synthetic peptide
  N-terminus acetylated
LSWAADMQAVVWDTMASGLDKDYLKPDD

SEQ ID NO: 222 - protein, 28 aa, Artificial Sequence
  Description of Artificial Sequence: Synthetic peptide
LSTAADLQAVVWDTMASGLDKDYLKPDD

SEQ ID NO: 223 - protein, 28 aa, Artificial Sequence
  Description of Artificial Sequence: Synthetic peptide
  N-terminus acetylated
LSTAADLQAVVWDTMASGLDKDYLKPDD

SEQ ID NO: 224 - protein, 28 aa, Artificial Sequence
  Description of Artificial Sequence: Synthetic peptide
LSWAADLQAVVWDTMASGLDKDYLKPDD

SEQ ID NO: 225 - protein, 28 aa, Artificial Sequence
  Description of Artificial Sequence: Synthetic peptide
  N-terminus acetylated
LSWAADLQAVVWDTMASGLDKDYLKPDD

SEQ ID NO: 226 - protein, 28 aa, Artificial Sequence
  Description of Artificial Sequence: Synthetic peptide
LSTAADVQAVVWDTMASGLDKDYLKPDD

SEQ ID NO: 227 - protein, 28 aa, Artificial Sequence
  Description of Artificial Sequence: Synthetic peptide
  N-terminus acetylated
LSTAADVQAVVWDTMASGLDKDYLKPDD

SEQ ID NO: 228 - protein, 28 aa, Artificial Sequence
  Description of Artificial Sequence: Synthetic peptide
LSWAADVQAVVWDTMASGLDKDYLKPDD

SEQ ID NO: 229 - protein, 28 aa, Artificial Sequence
  Description of Artificial Sequence: Synthetic peptide
  N-terminus acetylated
LSWAADVQAVVWDTMASGLDKDYLKPDD

SEQ ID NO: 230 - protein, 28 aa, Artificial Sequence
  Description of Artificial Sequence: Synthetic peptide
LSTAADMWAVVWDTMASGLDKDYLKPDD

SEQ ID NO: 231 - protein, 28 aa, Artificial Sequence
  Description of Artificial Sequence: Synthetic peptide
  N-terminus acetylated
LSTAADMWAVVWDTMASGLDKDYLKPDD

SEQ ID NO: 232 - protein, 28 aa, Artificial Sequence
  Description of Artificial Sequence: Synthetic peptide
LSWAADMWAVVWDTMASGLDKDYLKPDD

SEQ ID NO: 233 - protein, 28 aa, Artificial Sequence
  Description of Artificial Sequence: Synthetic peptide
  N-terminus acetylated
LSWAADMWAVVWDTMASGLDKDYLKPDD

SEQ ID NO: 234 - protein, 28 aa, Artificial Sequence
  Description of Artificial Sequence: Synthetic peptide
LSTAADLWAVVWDTMASGLDKDYLKPDD

SEQ ID NO: 235 - protein, 28 aa, Artificial Sequence
  Description of Artificial Sequence: Synthetic peptide
  N-terminus acetylated
LSTAADLWAVVWDTMASGLDKDYLKPDD

SEQ ID NO: 236 - protein, 28 aa, Artificial Sequence
  Description of Artificial Sequence: Synthetic peptide
LSWAADLWAVVWDTMASGLDKDYLKPDD

SEQ ID NO: 237 - protein, 28 aa, Artificial Sequence
  Description of Artificial Sequence: Synthetic peptide
  N-terminus acetylated
LSWAADLWAVVWDTMASGLDKDYLKPDD

SEQ ID NO: 238 - protein, 28 aa, Artificial Sequence
  Description of Artificial Sequence: Synthetic peptide
LSTAADVWAVVWDTMASGLDKDYLKPDD

SEQ ID NO: 239 - protein, 28 aa, Artificial Sequence
  Description of Artificial Sequence: Synthetic peptide
  N-terminus acetylated
LSTAADVWAVVWDTMASGLDKDYLKPDD

SEQ ID NO: 240 - protein, 28 aa, Artificial Sequence
  Description of Artificial Sequence: Synthetic peptide
LSWAADVWAVVWDTMASGLDKDYLKPDD

SEQ ID NO: 241 - protein, 28 aa, Artificial Sequence
  Description of Artificial Sequence: Synthetic peptide
  N-terminus acetylated
LSWAADVWAVVWDTMASGLDKDYLKPDD

SEQ ID NO: 242 - protein, 28 aa, Artificial Sequence
  Description of Artificial Sequence: Synthetic peptide
LSTAADMQGVVTDWMASGLDKDYLKPDD

SEQ ID NO: 243 - protein, 28 aa, Artificial Sequence
  Description of Artificial Sequence: Synthetic peptide
  N-terminus acetylated
LSTAADMQGVVTDWMASGLDKDYLKPDD

SEQ ID NO: 244 - protein, 28 aa, Artificial Sequence
  Description of Artificial Sequence: Synthetic peptide
LSWAADMQGVVTDWMASGLDKDYLKPDD

SEQ ID NO: 245 - protein, 28 aa, Artificial Sequence
  Description of Artificial Sequence: Synthetic peptide
  N-terminus acetylated
LSWAADMQGVVTDWMASGLDKDYLKPDD

SEQ ID NO: 246 - protein, 28 aa, Artificial Sequence
  Description of Artificial Sequence: Synthetic peptide
LSTAADLQGVVTDWMASGLDKDYLKPDD

SEQ ID NO: 247 - protein, 28 aa, Artificial Sequence
  Description of Artificial Sequence: Synthetic peptide
  N-terminus acetylated
LSTAADLQGVVTDWMASGLDKDYLKPDD

SEQ ID NO: 248 - protein, 28 aa, Artificial Sequence
  Description of Artificial Sequence: Synthetic peptide
LSWAADLQGVVTDWMASGLDKDYLKPDD

SEQ ID NO: 249 - protein, 28 aa, Artificial Sequence
  Description of Artificial Sequence: Synthetic peptide
  N-terminus acetylated
LSWAADLQGVVTDWMASGLDKDYLKPDD

SEQ ID NO: 250 - protein, 28 aa, Artificial Sequence
  Description of Artificial Sequence: Synthetic peptide
LSTAADVQGVVTDWMASGLDKDYLKPDD

SEQ ID NO: 251 - protein, 28 aa, Artificial Sequence
  Description of Artificial Sequence: Synthetic peptide
  N-terminus acetylated
LSTAADVQGVVTDWMASGLDKDYLKPDD

SEQ ID NO: 252 - protein, 28 aa, Artificial Sequence
  Description of Artificial Sequence: Synthetic peptide
LSWAADVQGVVTDWMASGLDKDYLKPDD

SEQ ID NO: 253 - protein, 28 aa, Artificial Sequence
  Description of Artificial Sequence: Synthetic peptide
  N-terminus acetylated
LSWAADVQGVVTDWMASGLDKDYLKPDD

SEQ ID NO: 254 - protein, 28 aa, Artificial Sequence
  Description of Artificial Sequence: Synthetic peptide
LSTAADMWGVVTDWMASGLDKDYLKPDD

SEQ ID NO: 255 - protein, 28 aa, Artificial Sequence
  Description of Artificial Sequence: Synthetic peptide
  N-terminus acetylated
LSTAADMWGVVTDWMASGLDKDYLKPDD

SEQ ID NO: 256 - protein, 28 aa, Artificial Sequence
  Description of Artificial Sequence: Synthetic peptide
LSWAADMWGVVTDWMASGLDKDYLKPDD

SEQ ID NO: 257 - protein, 28 aa, Artificial Sequence
  Description of Artificial Sequence: Synthetic peptide
  N-terminus acetylated
LSWAADMWGVVTDWMASGLDKDYLKPDD

SEQ ID NO: 258 - protein, 28 aa, Artificial Sequence
  Description of Artificial Sequence: Synthetic peptide
LSTAADLWGVVTDWMASGLDKDYLKPDD

SEQ ID NO: 259 - protein, 28 aa, Artificial Sequence
  Description of Artificial Sequence: Synthetic peptide
  N-terminus acetylated
LSTAADLWGVVTDWMASGLDKDYLKPDD

SEQ ID NO: 260 - protein, 28 aa, Artificial Sequence
  Description of Artificial Sequence: Synthetic peptide
LSWAADLWGVVTDWMASGLDKDYLKPDD

SEQ ID NO: 261 - protein, 28 aa, Artificial Sequence
  Description of Artificial Sequence: Synthetic peptide
  N-terminus acetylated
LSWAADLWGVVTDWMASGLDKDYLKPDD

SEQ ID NO: 262 - protein, 28 aa, Artificial Sequence
  Description of Artificial Sequence: Synthetic peptide
LSTAADVWGVVTDWMASGLDKDYLKPDD

SEQ ID NO: 263 - protein, 28 aa, Artificial Sequence
  Description of Artificial Sequence: Synthetic peptide
  N-terminus acetylated
LSTAADVWGVVTDWMASGLDKDYLKPDD

SEQ ID NO: 264 - protein, 28 aa, Artificial Sequence
  Description of Artificial Sequence: Synthetic peptide
LSWAADVWGVVTDWMASGLDKDYLKPDD

SEQ ID NO: 265 - protein, 28 aa, Artificial Sequence
  Description of Artificial Sequence: Synthetic peptide
  N-terminus acetylated
LSWAADVWGVVTDWMASGLDKDYLKPDD

SEQ ID NO: 266 - protein, 28 aa, Artificial Sequence
  Description of Artificial Sequence: Synthetic peptide
LSTAADMQAVVTDWMASGLDKDYLKPDD

SEQ ID NO: 267 - protein, 28 aa, Artificial Sequence
  Description of Artificial Sequence: Synthetic peptide
  N-terminus acetylated
LSTAADMQAVVTDWMASGLDKDYLKPDD

SEQ ID NO: 268 - protein, 28 aa, Artificial Sequence
  Description of Artificial Sequence: Synthetic peptide
LSWAADMQAVVTDWMASGLDKDYLKPDD

SEQ ID NO: 269 - protein, 28 aa, Artificial Sequence
  Description of Artificial Sequence: Synthetic peptide
  N-terminus acetylated
LSWAADMQAVVTDWMASGLDKDYLKPDD

SEQ ID NO: 270 - protein, 28 aa, Artificial Sequence
  Description of Artificial Sequence: Synthetic peptide
LSTAADLQAVVTDWMASGLDKDYLKPDD

SEQ ID NO: 271 - protein, 28 aa, Artificial Sequence
  Description of Artificial Sequence: Synthetic peptide
  N-terminus acetylated
LSTAADLQAVVTDWMASGLDKDYLKPDD

SEQ ID NO: 272 - protein, 28 aa, Artificial Sequence
  Description of Artificial Sequence: Synthetic peptide
LSWAADLQAVVTDWMASGLDKDYLKPDD

SEQ ID NO: 273 - protein, 28 aa, Artificial Sequence
  Description of Artificial Sequence: Synthetic peptide
  N-terminus acetylated
LSWAADLQAVVTDWMASGLDKDYLKPDD

SEQ ID NO: 274 - protein, 28 aa, Artificial Sequence
  Description of Artificial Sequence: Synthetic peptide
LSTAADVQAVVTDWMASGLDKDYLKPDD

SEQ ID NO: 275 - protein, 28 aa, Artificial Sequence
  Description of Artificial Sequence: Synthetic peptide
  N-terminus acetylated
LSTAADVQAVVTDWMASGLDKDYLKPDD

SEQ ID NO: 276 - protein, 28 aa, Artificial Sequence
  Description of Artificial Sequence: Synthetic peptide
LSWAADVQAVVTDWMASGLDKDYLKPDD

SEQ ID NO: 277 - protein, 28 aa, Artificial Sequence
  Description of Artificial Sequence: Synthetic peptide
  N-terminus acetylated
LSWAADVQAVVTDWMASGLDKDYLKPDD

SEQ ID NO: 278 - protein, 28 aa, Artificial Sequence
  Description of Artificial Sequence: Synthetic peptide
LSTAADMWAVVTDWMASGLDKDYLKPDD

SEQ ID NO: 279 - protein, 28 aa, Artificial Sequence
  Description of Artificial Sequence: Synthetic peptide
  N-terminus acetylated
LSTAADMWAVVTDWMASGLDKDYLKPDD

SEQ ID NO: 280 - protein, 28 aa, Artificial Sequence
  Description of Artificial Sequence: Synthetic peptide
LSWAADMWAVVTDWMASGLDKDYLKPDD

SEQ ID NO: 281 - protein, 28 aa, Artificial Sequence
  Description of Artificial Sequence: Synthetic peptide
  N-terminus acetylated
LSWAADMWAVVTDWMASGLDKDYLKPDD

SEQ ID NO: 282 - protein, 28 aa, Artificial Sequence
  Description of Artificial Sequence: Synthetic peptide
LSTAADLWAVVTDWMASGLDKDYLKPDD

SEQ ID NO: 283 - protein, 28 aa, Artificial Sequence
  Description of Artificial Sequence: Synthetic peptide
  N-terminus acetylated
LSTAADLWAVVTDWMASGLDKDYLKPDD

SEQ ID NO: 284 - protein, 28 aa, Artificial Sequence
  Description of Artificial Sequence: Synthetic peptide
LSWAADLWAVVTDWMASGLDKDYLKPDD

SEQ ID NO: 285 - protein, 28 aa, Artificial Sequence
  Description of Artificial Sequence: Synthetic peptide
  N-terminus acetylated
LSWAADLWAVVTDWMASGLDKDYLKPDD

SEQ ID NO: 286 - protein, 28 aa, Artificial Sequence
  Description of Artificial Sequence: Synthetic peptide
LSTAADVWAVVTDWMASGLDKDYLKPDD

SEQ ID NO: 287 - protein, 28 aa, Artificial Sequence
  Description of Artificial Sequence: Synthetic peptide
  N-terminus acetylated
LSTAADVWAVVTDWMASGLDKDYLKPDD

SEQ ID NO: 288 - protein, 28 aa, Artificial Sequence
  Description of Artificial Sequence: Synthetic peptide
LSWAADVWAVVTDWMASGLDKDYLKPDD

SEQ ID NO: 289 - protein, 28 aa, Artificial Sequence
  Description of Artificial Sequence: Synthetic peptide
  N-terminus acetylated
LSWAADVWAVVTDWMASGLDKDYLKPDD

SEQ ID NO: 290 - protein, 28 aa, Artificial Sequence
  Description of Artificial Sequence: Synthetic peptide
LSTAADMQGVVWDWMASGLDKDYLKPDD

SEQ ID NO: 291 - protein, 28 aa, Artificial Sequence
  Description of Artificial Sequence: Synthetic peptide
  N-terminus acetylated
LSTAADMQGVVWDWMASGLDKDYLKPDD

SEQ ID NO: 292 - protein, 28 aa, Artificial Sequence
  Description of Artificial Sequence: Synthetic peptide
LSWAADMQGVVWDWMASGLDKDYLKPDD

SEQ ID NO: 293 - protein, 28 aa, Artificial Sequence
  Description of Artificial Sequence: Synthetic peptide
  N-terminus acetylated
LSWAADMQGVVWDWMASGLDKDYLKPDD

SEQ ID NO: 294 - protein, 28 aa, Artificial Sequence
  Description of Artificial Sequence: Synthetic peptide
LSTAADLQGVVWDWMASGLDKDYLKPDD

SEQ ID NO: 295 - protein, 28 aa, Artificial Sequence
  Description of Artificial Sequence: Synthetic peptide
  N-terminus acetylated
LSTAADLQGVVWDWMASGLDKDYLKPDD

SEQ ID NO: 296 - protein, 28 aa, Artificial Sequence
  Description of Artificial Sequence: Synthetic peptide
LSWAADLQGVVWDWMASGLDKDYLKPDD

SEQ ID NO: 297 - protein, 28 aa, Artificial Sequence
  Description of Artificial Sequence: Synthetic peptide
  N-terminus acetylated
LSWAADLQGVVWDWMASGLDKDYLKPDD

SEQ ID NO: 298 - protein, 28 aa, Artificial Sequence
  Description of Artificial Sequence: Synthetic peptide
LSTAADVQGVVWDWMASGLDKDYLKPDD

SEQ ID NO: 299 - protein, 28 aa, Artificial Sequence
  Description of Artificial Sequence: Synthetic peptide
  N-terminus acetylated
LSTAADVQGVVWDWMASGLDKDYLKPDD

SEQ ID NO: 300 - protein, 28 aa, Artificial Sequence
  Description of Artificial Sequence: Synthetic peptide
LSWAADVQGVVWDWMASGLDKDYLKPDD

SEQ ID NO: 301 - protein, 28 aa, Artificial Sequence
  Description of Artificial Sequence: Synthetic peptide
  N-terminus acetylated
LSWAADVQGVVWDWMASGLDKDYLKPDD

SEQ ID NO: 302 - protein, 28 aa, Artificial Sequence
  Description of Artificial Sequence: Synthetic peptide
LSTAADMWGVVWDWMASGLDKDYLKPDD

SEQ ID NO: 303 - protein, 28 aa, Artificial Sequence
  Description of Artificial Sequence: Synthetic peptide
  N-terminus acetylated
LSTAADMWGVVWDWMASGLDKDYLKPDD

SEQ ID NO: 304 - protein, 28 aa, Artificial Sequence
  Description of Artificial Sequence: Synthetic peptide
LSWAADMWGVVWDWMASGLDKDYLKPDD

SEQ ID NO: 305 - protein, 28 aa, Artificial Sequence
  Description of Artificial Sequence: Synthetic peptide
  N-terminus acetylated
LSWAADMWGVVWDWMASGLDKDYLKPDD

SEQ ID NO: 306 - protein, 28 aa, Artificial Sequence
  Description of Artificial Sequence: Synthetic peptide
LSTAADLWGVVWDWMASGLDKDYLKPDD

SEQ ID NO: 307 - protein, 28 aa, Artificial Sequence
  Description of Artificial Sequence: Synthetic peptide
  N-terminus acetylated
LSTAADLWGVVWDWMASGLDKDYLKPDD

SEQ ID NO: 308 - protein, 28 aa, Artificial Sequence
  Description of Artificial Sequence: Synthetic peptide
LSWAADLWGVVWDWMASGLDKDYLKPDD

SEQ ID NO: 309 - protein, 28 aa, Artificial Sequence
  Description of Artificial Sequence: Synthetic peptide
  N-terminus acetylated
LSWAADLWGVVWDWMASGLDKDYLKPDD

SEQ ID NO: 310 - protein, 28 aa, Artificial Sequence
  Description of Artificial Sequence: Synthetic peptide
LSTAADVWGVVWDWMASGLDKDYLKPDD

SEQ ID NO: 311 - protein, 28 aa, Artificial Sequence
  Description of Artificial Sequence: Synthetic peptide
  N-terminus acetylated
LSTAADVWGVVWDWMASGLDKDYLKPDD

SEQ ID NO: 312 - protein, 28 aa, Artificial Sequence
  Description of Artificial Sequence: Synthetic peptide
LSWAADVWGVVWDWMASGLDKDYLKPDD

SEQ ID NO: 313 - protein, 28 aa, Artificial Sequence
  Description of Artificial Sequence: Synthetic peptide
  N-terminus acetylated
LSWAADVWGVVWDWMASGLDKDYLKPDD

SEQ ID NO: 314 - protein, 28 aa, Artificial Sequence
  Description of Artificial Sequence: Synthetic peptide
LSTAADMQAVVWDWMASGLDKDYLKPDD

SEQ ID NO: 315 - protein, 28 aa, Artificial Sequence
  Description of Artificial Sequence: Synthetic peptide
  N-terminus acetylated
LSTAADMQAVVWDWMASGLDKDYLKPDD

SEQ ID NO: 316 - protein, 28 aa, Artificial Sequence
  Description of Artificial Sequence: Synthetic peptide
LSWAADMQAVVWDWMASGLDKDYLKPDD

SEQ ID NO: 317 - protein, 28 aa, Artificial Sequence
  Description of Artificial Sequence: Synthetic peptide
  N-terminus acetylated
LSWAADMQAVVWDWMASGLDKDYLKPDD

SEQ ID NO: 318 - protein, 28 aa, Artificial Sequence
  Description of Artificial Sequence: Synthetic peptide
LSTAADLQAVVWDWMASGLDKDYLKPDD

SEQ ID NO: 319 - protein, 28 aa, Artificial Sequence
  Description of Artificial Sequence: Synthetic peptide
  N-terminus acetylated
LSTAADLQAVVWDWMASGLDKDYLKPDD

SEQ ID NO: 320 - protein, 28 aa, Artificial Sequence
  Description of Artificial Sequence: Synthetic peptide
LSWAADLQAVVWDWMASGLDKDYLKPDD

SEQ ID NO: 321 - protein, 28 aa, Artificial Sequence
  Description of Artificial Sequence: Synthetic peptide
  N-terminus acetylated
LSWAADLQAVVWDWMASGLDKDYLKPDD

SEQ ID NO: 322 - protein, 28 aa, Artificial Sequence
  Description of Artificial Sequence: Synthetic peptide
LSTAADVQAVVWDWMASGLDKDYLKPDD

SEQ ID NO: 323 - protein, 28 aa, Artificial Sequence
  Description of Artificial Sequence: Synthetic peptide
  N-terminus acetylated
LSTAADVQAVVWDWMASGLDKDYLKPDD

SEQ ID NO: 324 - protein, 28 aa, Artificial Sequence
  Description of Artificial Sequence: Synthetic peptide
LSWAADVQAVVWDWMASGLDKDYLKPDD

SEQ ID NO: 325 - protein, 28 aa, Artificial Sequence
  Description of Artificial Sequence: Synthetic peptide
  N-terminus acetylated
LSWAADVQAVVWDWMASGLDKDYLKPDD

SEQ ID NO: 326 - protein, 28 aa, Artificial Sequence
  Description of Artificial Sequence: Synthetic peptide
LSTAADMWAVVWDWMASGLDKDYLKPDD

SEQ ID NO: 327 - protein, 28 aa, Artificial Sequence
  Description of Artificial Sequence: Synthetic peptide
  N-terminus acetylated
LSTAADMWAVVWDWMASGLDKDYLKPDD

SEQ ID NO: 328 - protein, 28 aa, Artificial Sequence
  Description of Artificial Sequence: Synthetic peptide
LSWAADMWAVVWDWMASGLDKDYLKPDD

SEQ ID NO: 329 - protein, 28 aa, Artificial Sequence
  Description of Artificial Sequence: Synthetic peptide
  N-terminus acetylated
LSWAADMWAVVWDWMASGLDKDYLKPDD

SEQ ID NO: 330 - protein, 28 aa, Artificial Sequence
  Description of Artificial Sequence: Synthetic peptide
LSTAADLWAVVWDWMASGLDKDYLKPDD

SEQ ID NO: 331 - protein, 28 aa, Artificial Sequence
  Description of Artificial Sequence: Synthetic peptide
  N-terminus acetylated
LSTAADLWAVVWDWMASGLDKDYLKPDD

SEQ ID NO: 332 - protein, 28 aa, Artificial Sequence
  Description of Artificial Sequence: Synthetic peptide
LSWAADLWAVVWDWMASGLDKDYLKPDD

SEQ ID NO: 333 - protein, 28 aa, Artificial Sequence
  Description of Artificial Sequence: Synthetic peptide
  N-terminus acetylated
LSWAADLWAVVWDWMASGLDKDYLKPDD

SEQ ID NO: 334 - protein, 28 aa, Artificial Sequence
  Description of Artificial Sequence: Synthetic peptide
LSTAADVWAVVWDWMASGLDKDYLKPDD

SEQ ID NO: 335 - protein, 28 aa, Artificial Sequence
  Description of Artificial Sequence: Synthetic peptide
  N-terminus acetylated
LSTAADVWAVVWDWMASGLDKDYLKPDD

SEQ ID NO: 336 - protein, 28 aa, Artificial Sequence
  Description of Artificial Sequence: Synthetic peptide
LSWAADVWAVVWDWMASGLDKDYLKPDD

SEQ ID NO: 337 - protein, 28 aa, Artificial Sequence
  Description of Artificial Sequence: Synthetic peptide
  N-terminus acetylated
LSWAADVWAVVWDWMASGLDKDYLKPDD

SEQ ID NO: 338 - protein, 28 aa, Artificial Sequence
  Description of Artificial Sequence: Synthetic peptide
LSTAADMQGVVTDGLASGLDKDYLKPDD

SEQ ID NO: 339 - protein, 28 aa, Artificial Sequence
  Description of Artificial Sequence: Synthetic peptide
  N-terminus acetylated
LSTAADMQGVVTDGLASGLDKDYLKPDD

SEQ ID NO: 340 - protein, 28 aa, Artificial Sequence
  Description of Artificial Sequence: Synthetic peptide
LSWAADMQGVVTDGLASGLDKDYLKPDD

SEQ ID NO: 341 - protein, 28 aa, Artificial Sequence
  Description of Artificial Sequence: Synthetic peptide
  N-terminus acetylated
LSWAADMQGVVTDGLASGLDKDYLKPDD

SEQ ID NO: 342 - protein, 28 aa, Artificial Sequence
  Description of Artificial Sequence: Synthetic peptide
LSTAADLQGVVTDGLASGLDKDYLKPDD

SEQ ID NO: 343 - protein, 28 aa, Artificial Sequence
  Description of Artificial Sequence: Synthetic peptide
  N-terminus acetylated
LSTAADLQGVVTDGLASGLDKDYLKPDD

SEQ ID NO: 344 - protein, 28 aa, Artificial Sequence
  Description of Artificial Sequence: Synthetic peptide
LSWAADLQGVVTDGLASGLDKDYLKPDD

SEQ ID NO: 345 - protein, 28 aa, Artificial Sequence
  Description of Artificial Sequence: Synthetic peptide
  N-terminus acetylated
LSWAADLQGVVTDGLASGLDKDYLKPDD

SEQ ID NO: 346 - protein, 28 aa, Artificial Sequence
  Description of Artificial Sequence: Synthetic peptide
LSTAADVQGVVTDGLASGLDKDYLKPDD

SEQ ID NO: 347 - protein, 28 aa, Artificial Sequence
  Description of Artificial Sequence: Synthetic peptide
  N-terminus acetylated
LSTAADVQGVVTDGLASGLDKDYLKPDD

SEQ ID NO: 348 - protein, 28 aa, Artificial Sequence
  Description of Artificial Sequence: Synthetic peptide
LSWAADVQGVVTDGLASGLDKDYLKPDD

SEQ ID NO: 349 - protein, 28 aa, Artificial Sequence
  Description of Artificial Sequence: Synthetic peptide
  N-terminus acetylated
LSWAADVQGVVTDGLASGLDKDYLKPDD

SEQ ID NO: 350 - protein, 28 aa, Artificial Sequence
  Description of Artificial Sequence: Synthetic peptide
LSTAADMWGVVTDGLASGLDKDYLKPDD

SEQ ID NO: 351 - protein, 28 aa, Artificial Sequence
  Description of Artificial Sequence: Synthetic peptide
  N-terminus acetylated
LSTAADMWGVVTDGLASGLDKDYLKPDD

SEQ ID NO: 352 - protein, 28 aa, Artificial Sequence
  Description of Artificial Sequence: Synthetic peptide
LSWAADMWGVVTDGLASGLDKDYLKPDD

SEQ ID NO: 353 - protein, 28 aa, Artificial Sequence
  Description of Artificial Sequence: Synthetic peptide
  N-terminus acetylated
LSWAADMWGVVTDGLASGLDKDYLKPDD

SEQ ID NO: 354 - protein, 28 aa, Artificial Sequence
  Description of Artificial Sequence: Synthetic peptide
LSTAADLWGVVTDGLASGLDKDYLKPDD

SEQ ID NO: 355 - protein, 28 aa, Artificial Sequence
  Description of Artificial Sequence: Synthetic peptide
  N-terminus acetylated
LSTAADLWGVVTDGLASGLDKDYLKPDD

SEQ ID NO: 356 - protein, 28 aa, Artificial Sequence
  Description of Artificial Sequence: Synthetic peptide
LSWAADLWGVVTDGLASGLDKDYLKPDD

SEQ ID NO: 357 - protein, 28 aa, Artificial Sequence
  Description of Artificial Sequence: Synthetic peptide
  N-terminus acetylated
LSWAADLWGVVTDGLASGLDKDYLKPDD

SEQ ID NO: 358 - protein, 28 aa, Artificial Sequence
  Description of Artificial Sequence: Synthetic peptide
LSTAADVWGVVTDGLASGLDKDYLKPDD

SEQ ID NO: 359 - protein, 28 aa, Artificial Sequence
  Description of Artificial Sequence: Synthetic peptide
  N-terminus acetylated
LSTAADVWGVVTDGLASGLDKDYLKPDD

SEQ ID NO: 360 - protein, 28 aa, Artificial Sequence
  Description of Artificial Sequence: Synthetic peptide
LSWAADVWGVVTDGLASGLDKDYLKPDD

SEQ ID NO: 361 - protein, 28 aa, Artificial Sequence
  Description of Artificial Sequence: Synthetic peptide
  N-terminus acetylated
LSWAADVWGVVTDGLASGLDKDYLKPDD

SEQ ID NO: 362 - protein, 28 aa, Artificial Sequence
  Description of Artificial Sequence: Synthetic peptide
LSTAADMQAVVTDGLASGLDKDYLKPDD

SEQ ID NO: 363 - protein, 28 aa, Artificial Sequence
  Description of Artificial Sequence: Synthetic peptide
  N-terminus acetylated
LSTAADMQAVVTDGLASGLDKDYLKPDD

SEQ ID NO: 364 - protein, 28 aa, Artificial Sequence
  Description of Artificial Sequence: Synthetic peptide
LSWAADMQAVVTDGLASGLDKDYLKPDD

SEQ ID NO: 365 - protein, 28 aa, Artificial Sequence
  Description of Artificial Sequence: Synthetic peptide
  N-terminus acetylated
LSWAADMQAVVTDGLASGLDKDYLKPDD

SEQ ID NO: 366 - protein, 28 aa, Artificial Sequence
  Description of Artificial Sequence: Synthetic peptide
LSTAADLQAVVTDGLASGLDKDYLKPDD

SEQ ID NO: 367 - protein, 28 aa, Artificial Sequence
  Description of Artificial Sequence: Synthetic peptide
  N-terminus acetylated
LSTAADLQAVVTDGLASGLDKDYLKPDD

SEQ ID NO: 368 - protein, 28 aa, Artificial Sequence
  Description of Artificial Sequence: Synthetic peptide
LSWAADLQAVVTDGLASGLDKDYLKPDD

SEQ ID NO: 369 - protein, 28 aa, Artificial Sequence
  Description of Artificial Sequence: Synthetic peptide
  N-terminus acetylated
LSWAADLQAVVTDGLASGLDKDYLKPDD

SEQ ID NO: 370 - protein, 28 aa, Artificial Sequence
  Description of Artificial Sequence: Synthetic peptide
LSTAADVQAVVTDGLASGLDKDYLKPDD

SEQ ID NO: 371 - protein, 28 aa, Artificial Sequence
  Description of Artificial Sequence: Synthetic peptide
  N-terminus acetylated
LSTAADVQAVVTDGLASGLDKDYLKPDD

SEQ ID NO: 372 - protein, 28 aa, Artificial Sequence
  Description of Artificial Sequence: Synthetic peptide
LSWAADVQAVVTDGLASGLDKDYLKPDD

SEQ ID NO: 373 - protein, 28 aa, Artificial Sequence
  Description of Artificial Sequence: Synthetic peptide
  N-terminus acetylated
LSWAADVQAVVTDGLASGLDKDYLKPDD

SEQ ID NO: 374 - protein, 28 aa, Artificial Sequence
  Description of Artificial Sequence: Synthetic peptide
LSTAADMWAVVTDGLASGLDKDYLKPDD

SEQ ID NO: 375 - protein, 28 aa, Artificial Sequence
  Description of Artificial Sequence: Synthetic peptide
  N-terminus acetylated
LSTAADMWAVVTDGLASGLDKDYLKPDD

SEQ ID NO: 376 - protein, 28 aa, Artificial Sequence
  Description of Artificial Sequence: Synthetic peptide
LSWAADMWAVVTDGLASGLDKDYLKPDD

SEQ ID NO: 377 - protein, 28 aa, Artificial Sequence
  Description of Artificial Sequence: Synthetic peptide
  N-terminus acetylated
LSWAADMWAVVTDGLASGLDKDYLKPDD

SEQ ID NO: 378 - protein, 28 aa, Artificial Sequence
  Description of Artificial Sequence: Synthetic peptide
LSTAADLWAVVTDGLASGLDKDYLKPDD

SEQ ID NO: 379 - protein, 28 aa, Artificial Sequence
  Description of Artificial Sequence: Synthetic peptide
  N-terminus acetylated
LSTAADLWAVVTDGLASGLDKDYLKPDD

SEQ ID NO: 380 - protein, 28 aa, Artificial Sequence
  Description of Artificial Sequence: Synthetic peptide
LSWAADLWAVVTDGLASGLDKDYLKPDD

SEQ ID NO: 381 - protein, 28 aa, Artificial Sequence
  Description of Artificial Sequence: Synthetic peptide
  N-terminus acetylated
LSWAADLWAVVTDGLASGLDKDYLKPDD

SEQ ID NO: 382 - protein, 28 aa, Artificial Sequence
  Description of Artificial Sequence: Synthetic peptide
LSTAADVWAVVTDGLASGLDKDYLKPDD

SEQ ID NO: 383 - protein, 28 aa, Artificial Sequence
  Description of Artificial Sequence: Synthetic peptide
  N-terminus acetylated
LSTAADVWAVVTDGLASGLDKDYLKPDD

SEQ ID NO: 384 - protein, 28 aa, Artificial Sequence
  Description of Artificial Sequence: Synthetic peptide
LSWAADVWAVVTDGLASGLDKDYLKPDD

SEQ ID NO: 385 - protein, 28 aa, Artificial Sequence
  Description of Artificial Sequence: Synthetic peptide
  N-terminus acetylated
LSWAADVWAVVTDGLASGLDKDYLKPDD

SEQ ID NO: 386 - protein, 28 aa, Artificial Sequence
  Description of Artificial Sequence: Synthetic peptide
LSTAADMQGVVWDGLASGLDKDYLKPDD

SEQ ID NO: 387 - protein, 28 aa, Artificial Sequence
  Description of Artificial Sequence: Synthetic peptide
  N-terminus acetylated
LSTAADMQGVVWDGLASGLDKDYLKPDD

SEQ ID NO: 388 - protein, 28 aa, Artificial Sequence
  Description of Artificial Sequence: Synthetic peptide
LSWAADMQGVVWDGLASGLDKDYLKPDD

SEQ ID NO: 389 - protein, 28 aa, Artificial Sequence
  Description of Artificial Sequence: Synthetic peptide
  N-terminus acetylated
LSWAADMQGVVWDGLASGLDKDYLKPDD

SEQ ID NO: 390 - protein, 28 aa, Artificial Sequence
  Description of Artificial Sequence: Synthetic peptide
LSTAADLQGVVWDGLASGLDKDYLKPDD

SEQ ID NO: 391 - protein, 28 aa, Artificial Sequence
  Description of Artificial Sequence: Synthetic peptide
  N-terminus acetylated
LSTAADLQGVVWDGLASGLDKDYLKPDD

SEQ ID NO: 392 - protein, 28 aa, Artificial Sequence
  Description of Artificial Sequence: Synthetic peptide
LSWAADLQGVVWDGLASGLDKDYLKPDD

SEQ ID NO: 393 - protein, 28 aa, Artificial Sequence
  Description of Artificial Sequence: Synthetic peptide
  N-terminus acetylated
LSWAADLQGVVWDGLASGLDKDYLKPDD

SEQ ID NO: 394 - protein, 28 aa, Artificial Sequence
  Description of Artificial Sequence: Synthetic peptide
LSTAADVQGVVWDGLASGLDKDYLKPDD

SEQ ID NO: 395 - protein, 28 aa, Artificial Sequence
  Description of Artificial Sequence: Synthetic peptide
  N-terminus acetylated
LSTAADVQGVVWDGLASGLDKDYLKPDD

SEQ ID NO: 396 - protein, 28 aa, Artificial Sequence
  Description of Artificial Sequence: Synthetic peptide
LSWAADVQGVVWDGLASGLDKDYLKPDD

SEQ ID NO: 397 - protein, 28 aa, Artificial Sequence
  Description of Artificial Sequence: Synthetic peptide
  N-terminus acetylated
LSWAADVQGVVWDGLASGLDKDYLKPDD

SEQ ID NO: 398 - protein, 28 aa, Artificial Sequence
  Description of Artificial Sequence: Synthetic peptide
LSTAADMWGVVWDGLASGLDKDYLKPDD

SEQ ID NO: 399 - protein, 28 aa, Artificial Sequence
  Description of Artificial Sequence: Synthetic peptide
  N-terminus acetylated
LSTAADMWGVVWDGLASGLDKDYLKPDD

SEQ ID NO: 400 - protein, 28 aa, Artificial Sequence
  Description of Artificial Sequence: Synthetic peptide
LSWAADMWGVVWDGLASGLDKDYLKPDD

SEQ ID NO: 401 - protein, 28 aa, Artificial Sequence
  Description of Artificial Sequence: Synthetic peptide
  N-terminus acetylated
LSWAADMWGVVWDGLASGLDKDYLKPDD

SEQ ID NO: 402 - protein, 28 aa, Artificial Sequence
  Description of Artificial Sequence: Synthetic peptide
LSTAADLWGVVWDGLASGLDKDYLKPDD

SEQ ID NO: 403 - protein, 28 aa, Artificial Sequence
  Description of Artificial Sequence: Synthetic peptide
  N-terminus acetylated
LSTAADLWGVVWDGLASGLDKDYLKPDD

SEQ ID NO: 404 - protein, 28 aa, Artificial Sequence
  Description of Artificial Sequence: Synthetic peptide
LSWAADLWGVVWDGLASGLDKDYLKPDD

SEQ ID NO: 405 - protein, 28 aa, Artificial Sequence
  Description of Artificial Sequence: Synthetic peptide
  N-terminus acetylated
LSWAADLWGVVWDGLASGLDKDYLKPDD

SEQ ID NO: 406 - protein, 28 aa, Artificial Sequence
  Description of Artificial Sequence: Synthetic peptide
LSTAADVWGVVWDGLASGLDKDYLKPDD

SEQ ID NO: 407 - protein, 28 aa, Artificial Sequence
  Description of Artificial Sequence: Synthetic peptide
  N-terminus acetylated
LSTAADVWGVVWDGLASGLDKDYLKPDD

SEQ ID NO: 408 - protein, 28 aa, Artificial Sequence
  Description of Artificial Sequence: Synthetic peptide
LSWAADVWGVVWDGLASGLDKDYLKPDD

SEQ ID NO: 409 - protein, 28 aa, Artificial Sequence
  Description of Artificial Sequence: Synthetic peptide
  N-terminus acetylated
LSWAADVWGVVWDGLASGLDKDYLKPDD

SEQ ID NO: 410 - protein, 28 aa, Artificial Sequence
  Description of Artificial Sequence: Synthetic peptide
LSTAADMQAVVWDGLASGLDKDYLKPDD

SEQ ID NO: 411 - protein, 28 aa, Artificial Sequence
  Description of Artificial Sequence: Synthetic peptide
  N-terminus acetylated
LSTAADMQAVVWDGLASGLDKDYLKPDD

SEQ ID NO: 412 - protein, 28 aa, Artificial Sequence
  Description of Artificial Sequence: Synthetic peptide
LSWAADMQAVVWDGLASGLDKDYLKPDD

SEQ ID NO: 413 - protein, 28 aa, Artificial Sequence
  Description of Artificial Sequence: Synthetic peptide
  N-terminus acetylated
LSWAADMQAVVWDGLASGLDKDYLKPDD

SEQ ID NO: 414 - protein, 28 aa, Artificial Sequence
  Description of Artificial Sequence: Synthetic peptide
LSTAADLQAVVWDGLASGLDKDYLKPDD

SEQ ID NO: 415 - protein, 28 aa, Artificial Sequence
  Description of Artificial Sequence: Synthetic peptide
  N-terminus acetylated
LSTAADLQAVVWDGLASGLDKDYLKPDD

SEQ ID NO: 416 - protein, 28 aa, Artificial Sequence
  Description of Artificial Sequence: Synthetic peptide
LSWAADLQAVVWDGLASGLDKDYLKPDD

SEQ ID NO: 417 - protein, 28 aa, Artificial Sequence
  Description of Artificial Sequence: Synthetic peptide
  N-terminus acetylated
LSWAADLQAVVWDGLASGLDKDYLKPDD

SEQ ID NO: 418 - protein, 28 aa, Artificial Sequence
  Description of Artificial Sequence: Synthetic peptide
LSTAADVQAVVWDGLASGLDKDYLKPDD

SEQ ID NO: 419 - protein, 28 aa, Artificial Sequence
  Description of Artificial Sequence: Synthetic peptide
  N-terminus acetylated
LSTAADVQAVVWDGLASGLDKDYLKPDD

SEQ ID NO: 420 - protein, 28 aa, Artificial Sequence
  Description of Artificial Sequence: Synthetic peptide
LSWAADVQAVVWDGLASGLDKDYLKPDD

SEQ ID NO: 421 - protein, 28 aa, Artificial Sequence
  Description of Artificial Sequence: Synthetic peptide
  N-terminus acetylated
LSWAADVQAVVWDGLASGLDKDYLKPDD

SEQ ID NO: 422 - protein, 28 aa, Artificial Sequence
  Description of Artificial Sequence: Synthetic peptide
LSTAADMWAVVWDGLASGLDKDYLKPDD

SEQ ID NO: 423 - protein, 28 aa, Artificial Sequence
  Description of Artificial Sequence: Synthetic peptide
  N-terminus acetylated
LSTAADMWAVVWDGLASGLDKDYLKPDD

SEQ ID NO: 424 - protein, 28 aa, Artificial Sequence
  Description of Artificial Sequence: Synthetic peptide
LSWAADMWAVVWDGLASGLDKDYLKPDD

SEQ ID NO: 425 - protein, 28 aa, Artificial Sequence
  Description of Artificial Sequence: Synthetic peptide
  N-terminus acetylated
LSWAADMWAVVWDGLASGLDKDYLKPDD

SEQ ID NO: 426 - protein, 28 aa, Artificial Sequence
  Description of Artificial Sequence: Synthetic peptide
LSTAADLWAVVWDGLASGLDKDYLKPDD

SEQ ID NO: 427 - protein, 28 aa, Artificial Sequence
  Description of Artificial Sequence: Synthetic peptide
  N-terminus acetylated
LSTAADLWAVVWDGLASGLDKDYLKPDD

SEQ ID NO: 428 - protein, 28 aa, Artificial Sequence
  Description of Artificial Sequence: Synthetic peptide
LSWAADLWAVVWDGLASGLDKDYLKPDD

SEQ ID NO: 429 - protein, 28 aa, Artificial Sequence
  Description of Artificial Sequence: Synthetic peptide
  N-terminus acetylated
LSWAADLWAVVWDGLASGLDKDYLKPDD

SEQ ID NO: 430 - protein, 28 aa, Artificial Sequence
  Description of Artificial Sequence: Synthetic peptide
LSTAADVWAVVWDGLASGLDKDYLKPDD

SEQ ID NO: 431 - protein, 28 aa, Artificial Sequence
  Description of Artificial Sequence: Synthetic peptide
  N-terminus acetylated
LSTAADVWAVVWDGLASGLDKDYLKPDD

SEQ ID NO: 432 - protein, 28 aa, Artificial Sequence
  Description of Artificial Sequence: Synthetic peptide
LSWAADVWAVVWDGLASGLDKDYLKPDD

SEQ ID NO: 433 - protein, 28 aa, Artificial Sequence
  Description of Artificial Sequence: Synthetic peptide
  N-terminus acetylated
LSWAADVWAVVWDGLASGLDKDYLKPDD

SEQ ID NO: 434 - protein, 28 aa, Artificial Sequence
  Description of Artificial Sequence: Synthetic peptide
LSTAADMQGVVTDTLASGLDKDYLKPDD

SEQ ID NO: 435 - protein, 28 aa, Artificial Sequence
  Description of Artificial Sequence: Synthetic peptide
  N-terminus acetylated
LSTAADMQGVVTDTLASGLDKDYLKPDD

SEQ ID NO: 436 - protein, 28 aa, Artificial Sequence
  Description of Artificial Sequence: Synthetic peptide
LSWAADMQGVVTDTLASGLDKDYLKPDD

SEQ ID NO: 437 - protein, 28 aa, Artificial Sequence
  Description of Artificial Sequence: Synthetic peptide
  N-terminus acetylated
LSWAADMQGVVTDTLASGLDKDYLKPDD

SEQ ID NO: 438 - protein, 28 aa, Artificial Sequence
  Description of Artificial Sequence: Synthetic peptide
LSTAADLQGVVTDTLASGLDKDYLKPDD

SEQ ID NO: 439 - protein, 28 aa, Artificial Sequence
  Description of Artificial Sequence: Synthetic peptide
  N-terminus acetylated
LSTAADLQGVVTDTLASGLDKDYLKPDD

SEQ ID NO: 440 - protein, 28 aa, Artificial Sequence
  Description of Artificial Sequence: Synthetic peptide
LSWAADLQGVVTDTLASGLDKDYLKPDD

SEQ ID NO: 441 - protein, 28 aa, Artificial Sequence
  Description of Artificial Sequence: Synthetic peptide
  N-terminus acetylated
LSWAADLQGVVTDTLASGLDKDYLKPDD

SEQ ID NO: 442 - protein, 28 aa, Artificial Sequence
  Description of Artificial Sequence: Synthetic peptide
LSTAADVQGVVTDTLASGLDKDYLKPDD

SEQ ID NO: 443 - protein, 28 aa, Artificial Sequence
  Description of Artificial Sequence: Synthetic peptide
  N-terminus acetylated
LSTAADVQGVVTDTLASGLDKDYLKPDD

SEQ ID NO: 444 - protein, 28 aa, Artificial Sequence
  Description of Artificial Sequence: Synthetic peptide
LSWAADVQGVVTDTLASGLDKDYLKPDD

SEQ ID NO: 445 - protein, 28 aa, Artificial Sequence
  Description of Artificial Sequence: Synthetic peptide
  N-terminus acetylated
LSWAADVQGVVTDTLASGLDKDYLKPDD

SEQ ID NO: 446 - protein, 28 aa, Artificial Sequence
  Description of Artificial Sequence: Synthetic peptide
LSTAADMWGVVTDTLASGLDKDYLKPDD

SEQ ID NO: 447 - protein, 28 aa, Artificial Sequence
  Description of Artificial Sequence: Synthetic peptide
  N-terminus acetylated
LSTAADMWGVVTDTLASGLDKDYLKPDD

SEQ ID NO: 448 - protein, 28 aa, Artificial Sequence
  Description of Artificial Sequence: Synthetic peptide
LSWAADMWGVVTDTLASGLDKDYLKPDD

SEQ ID NO: 449 - protein, 28 aa, Artificial Sequence
  Description of Artificial Sequence: Synthetic peptide
  N-terminus acetylated
LSWAADMWGVVTDTLASGLDKDYLKPDD

SEQ ID NO: 450 - protein, 28 aa, Artificial Sequence
  Description of Artificial Sequence: Synthetic peptide
LSTAADLWGVVTDTLASGLDKDYLKPDD

SEQ ID NO: 451 - protein, 28 aa, Artificial Sequence
  Description of Artificial Sequence: Synthetic peptide
  N-terminus acetylated
LSTAADLWGVVTDTLASGLDKDYLKPDD

SEQ ID NO: 452 - protein, 28 aa, Artificial Sequence
  Description of Artificial Sequence: Synthetic peptide
LSWAADLWGVVTDTLASGLDKDYLKPDD

SEQ ID NO: 453 - protein, 28 aa, Artificial Sequence
  Description of Artificial Sequence: Synthetic peptide
  N-terminus acetylated
LSWAADLWGVVTDTLASGLDKDYLKPDD

SEQ ID NO: 454 - protein, 28 aa, Artificial Sequence
  Description of Artificial Sequence: Synthetic peptide
LSTAADVWGVVTDTLASGLDKDYLKPDD

SEQ ID NO: 455 - protein, 28 aa, Artificial Sequence
  Description of Artificial Sequence: Synthetic peptide
  N-terminus acetylated
LSTAADVWGVVTDTLASGLDKDYLKPDD

SEQ ID NO: 456 - protein, 28 aa, Artificial Sequence
  Description of Artificial Sequence: Synthetic peptide
LSWAADVWGVVTDTLASGLDKDYLKPDD

SEQ ID NO: 457 - protein, 28 aa, Artificial Sequence
  Description of Artificial Sequence: Synthetic peptide
  N-terminus acetylated
LSWAADVWGVVTDTLASGLDKDYLKPDD

SEQ ID NO: 458 - protein, 28 aa, Artificial Sequence
  Description of Artificial Sequence: Synthetic peptide
LSTAADMQAVVTDTLASGLDKDYLKPDD

SEQ ID NO: 459 - protein, 28 aa, Artificial Sequence
  Description of Artificial Sequence: Synthetic peptide
  N-terminus acetylated
LSTAADMQAVVTDTLASGLDKDYLKPDD

SEQ ID NO: 460 - protein, 28 aa, Artificial Sequence
  Description of Artificial Sequence: Synthetic peptide
LSWAADMQAVVTDTLASGLDKDYLKPDD

SEQ ID NO: 461 - protein, 28 aa, Artificial Sequence
  Description of Artificial Sequence: Synthetic peptide
  N-terminus acetylated
LSWAADMQAVVTDTLASGLDKDYLKPDD

SEQ ID NO: 462 - protein, 28 aa, Artificial Sequence
  Description of Artificial Sequence: Synthetic peptide
LSTAADLQAVVTDTLASGLDKDYLKPDD

SEQ ID NO: 463 - protein, 28 aa, Artificial Sequence
  Description of Artificial Sequence: Synthetic peptide
  N-terminus acetylated
LSTAADLQAVVTDTLASGLDKDYLKPDD

SEQ ID NO: 464 - protein, 28 aa, Artificial Sequence
  Description of Artificial Sequence: Synthetic peptide
LSWAADLQAVVTDTLASGLDKDYLKPDD

SEQ ID NO: 465 - protein, 28 aa, Artificial Sequence
  Description of Artificial Sequence: Synthetic peptide
  N-terminus acetylated
LSWAADLQAVVTDTLASGLDKDYLKPDD

SEQ ID NO: 466 - protein, 28 aa, Artificial Sequence
  Description of Artificial Sequence: Synthetic peptide
LSTAADVQAVVTDTLASGLDKDYLKPDD

SEQ ID NO: 467 - protein, 28 aa, Artificial Sequence
  Description of Artificial Sequence: Synthetic peptide
  N-terminus acetylated
LSTAADVQAVVTDTLASGLDKDYLKPDD

SEQ ID NO: 468 - protein, 28 aa, Artificial Sequence
  Description of Artificial Sequence: Synthetic peptide
LSWAADVQAVVTDTLASGLDKDYLKPDD

SEQ ID NO: 469 - protein, 28 aa, Artificial Sequence
  Description of Artificial Sequence: Synthetic peptide
  N-terminus acetylated
LSWAADVQAVVTDTLASGLDKDYLKPDD

SEQ ID NO: 470 - protein, 28 aa, Artificial Sequence
  Description of Artificial Sequence: Synthetic peptide
LSTAADMWAVVTDTLASGLDKDYLKPDD

SEQ ID NO: 471 - protein, 28 aa, Artificial Sequence
  Description of Artificial Sequence: Synthetic peptide
  N-terminus acetylated
LSTAADMWAVVTDTLASGLDKDYLKPDD

SEQ ID NO: 472 - protein, 28 aa, Artificial Sequence
  Description of Artificial Sequence: Synthetic peptide
LSWAADMWAVVTDTLASGLDKDYLKPDD

SEQ ID NO: 473 - protein, 28 aa, Artificial Sequence
  Description of Artificial Sequence: Synthetic peptide
  N-terminus acetylated
LSWAADMWAVVTDTLASGLDKDYLKPDD

SEQ ID NO: 474 - protein, 28 aa, Artificial Sequence
  Description of Artificial Sequence: Synthetic peptide
LSTAADLWAVVTDTLASGLDKDYLKPDD

SEQ ID NO: 475 - protein, 28 aa, Artificial Sequence
  Description of Artificial Sequence: Synthetic peptide
  N-terminus acetylated
LSTAADLWAVVTDTLASGLDKDYLKPDD

SEQ ID NO: 476 - protein, 28 aa, Artificial Sequence
  Description of Artificial Sequence: Synthetic peptide
LSWAADLWAVVTDTLASGLDKDYLKPDD

SEQ ID NO: 477 - protein, 28 aa, Artificial Sequence
  Description of Artificial Sequence: Synthetic peptide
  N-terminus acetylated
LSWAADLWAVVTDTLASGLDKDYLKPDD

SEQ ID NO: 478 - protein, 28 aa, Artificial Sequence
  Description of Artificial Sequence: Synthetic peptide
LSTAADVWAVVTDTLASGLDKDYLKPDD

SEQ ID NO: 479 - protein, 28 aa, Artificial Sequence
  Description of Artificial Sequence: Synthetic peptide
  N-terminus acetylated
LSTAADVWAVVTDTLASGLDKDYLKPDD

SEQ ID NO: 480 - protein, 28 aa, Artificial Sequence
  Description of Artificial Sequence: Synthetic peptide
LSWAADVWAVVTDTLASGLDKDYLKPDD

SEQ ID NO: 481 - protein, 28 aa, Artificial Sequence
  Description of Artificial Sequence: Synthetic peptide
  N-terminus acetylated
LSWAADVWAVVTDTLASGLDKDYLKPDD

SEQ ID NO: 482 - protein, 28 aa, Artificial Sequence
  Description of Artificial Sequence: Synthetic peptide
LSTAADMQGVVWDTLASGLDKDYLKPDD

SEQ ID NO: 483 - protein, 28 aa, Artificial Sequence
  Description of Artificial Sequence: Synthetic peptide
  N-terminus acetylated
LSTAADMQGVVWDTLASGLDKDYLKPDD

SEQ ID NO: 484 - protein, 28 aa, Artificial Sequence
  Description of Artificial Sequence: Synthetic peptide
LSWAADMQGVVWDTLASGLDKDYLKPDD

SEQ ID NO: 485 - protein, 28 aa, Artificial Sequence
  Description of Artificial Sequence: Synthetic peptide
  N-terminus acetylated
LSWAADMQGVVWDTLASGLDKDYLKPDD

SEQ ID NO: 486 - protein, 28 aa, Artificial Sequence
  Description of Artificial Sequence: Synthetic peptide
LSTAADLQGVVWDTLASGLDKDYLKPDD

SEQ ID NO: 487 - protein, 28 aa, Artificial Sequence
  Description of Artificial Sequence: Synthetic peptide
  N-terminus acetylated
LSTAADLQGVVWDTLASGLDKDYLKPDD

SEQ ID NO: 488 - protein, 28 aa, Artificial Sequence
  Description of Artificial Sequence: Synthetic peptide
LSWAADLQGVVWDTLASGLDKDYLKPDD

SEQ ID NO: 489 - protein, 28 aa, Artificial Sequence
  Description of Artificial Sequence: Synthetic peptide
  N-terminus acetylated
LSWAADLQGVVWDTLASGLDKDYLKPDD

SEQ ID NO: 490 - protein, 28 aa, Artificial Sequence
  Description of Artificial Sequence: Synthetic peptide
LSTAADVQGVVWDTLASGLDKDYLKPDD

SEQ ID NO: 491 - protein, 28 aa, Artificial Sequence
  Description of Artificial Sequence: Synthetic peptide
  N-terminus acetylated
LSTAADVQGVVWDTLASGLDKDYLKPDD

SEQ ID NO: 492 - protein, 28 aa, Artificial Sequence
  Description of Artificial Sequence: Synthetic peptide
LSWAADVQGVVWDTLASGLDKDYLKPDD

SEQ ID NO: 493 - protein, 28 aa, Artificial Sequence
  Description of Artificial Sequence: Synthetic peptide
  N-terminus acetylated
LSWAADVQGVVWDTLASGLDKDYLKPDD

SEQ ID NO: 494 - protein, 28 aa, Artificial Sequence
  Description of Artificial Sequence: Synthetic peptide
LSTAADMWGVVWDTLASGLDKDYLKPDD

SEQ ID NO: 495 - protein, 28 aa, Artificial Sequence
  Description of Artificial Sequence: Synthetic peptide
  N-terminus acetylated
LSTAADMWGVVWDTLASGLDKDYLKPDD

SEQ ID NO: 496 - protein, 28 aa, Artificial Sequence
  Description of Artificial Sequence: Synthetic peptide
LSWAADMWGVVWDTLASGLDKDYLKPDD

SEQ ID NO: 497 - protein, 28 aa, Artificial Sequence
  Description of Artificial Sequence: Synthetic peptide
  N-terminus acetylated
LSWAADMWGVVWDTLASGLDKDYLKPDD

SEQ ID NO: 498 - protein, 28 aa, Artificial Sequence
  Description of Artificial Sequence: Synthetic peptide
LSTAADLWGVVWDTLASGLDKDYLKPDD

SEQ ID NO: 499 - protein, 28 aa, Artificial Sequence
  Description of Artificial Sequence: Synthetic peptide
  N-terminus acetylated
LSTAADLWGVVWDTLASGLDKDYLKPDD

SEQ ID NO: 500 - protein, 28 aa, Artificial Sequence
  Description of Artificial Sequence: Synthetic peptide
LSWAADLWGVVWDTLASGLDKDYLKPDD

SEQ ID NO: 501 - protein, 28 aa, Artificial Sequence
  Description of Artificial Sequence: Synthetic peptide
  N-terminus acetylated
LSWAADLWGVVWDTLASGLDKDYLKPDD

SEQ ID NO: 502 - protein, 28 aa, Artificial Sequence
  Description of Artificial Sequence: Synthetic peptide
LSTAADVWGVVWDTLASGLDKDYLKPDD

SEQ ID NO: 503 - protein, 28 aa, Artificial Sequence
  Description of Artificial Sequence: Synthetic peptide
  N-terminus acetylated
LSTAADVWGVVWDTLASGLDKDYLKPDD

SEQ ID NO: 504 - protein, 28 aa, Artificial Sequence
  Description of Artificial Sequence: Synthetic peptide
LSWAADVWGVVWDTLASGLDKDYLKPDD

SEQ ID NO: 505 - protein, 28 aa, Artificial Sequence
  Description of Artificial Sequence: Synthetic peptide
  N-terminus acetylated
LSWAADVWGVVWDTLASGLDKDYLKPDD

SEQ ID NO: 506 - protein, 28 aa, Artificial Sequence
  Description of Artificial Sequence: Synthetic peptide
LSTAADMQAVVWDTLASGLDKDYLKPDD

SEQ ID NO: 507 - protein, 28 aa, Artificial Sequence
  Description of Artificial Sequence: Synthetic peptide
  N-terminus acetylated
LSTAADMQAVVWDTLASGLDKDYLKPDD

SEQ ID NO: 508 - protein, 28 aa, Artificial Sequence
  Description of Artificial Sequence: Synthetic peptide
LSWAADMQAVVWDTLASGLDKDYLKPDD

SEQ ID NO: 509 - protein, 28 aa, Artificial Sequence
  Description of Artificial Sequence: Synthetic peptide
  N-terminus acetylated
LSWAADMQAVVWDTLASGLDKDYLKPDD

SEQ ID NO: 510 - protein, 28 aa, Artificial Sequence
  Description of Artificial Sequence: Synthetic peptide
LSTAADLQAVVWDTLASGLDKDYLKPDD

SEQ ID NO: 511 - protein, 28 aa, Artificial Sequence
  Description of Artificial Sequence: Synthetic peptide
  N-terminus acetylated
LSTAADLQAVVWDTLASGLDKDYLKPDD

SEQ ID NO: 512 - protein, 28 aa, Artificial Sequence
  Description of Artificial Sequence: Synthetic peptide
LSWAADLQAVVWDTLASGLDKDYLKPDD

SEQ ID NO: 513 - protein, 28 aa, Artificial Sequence
  Description of Artificial Sequence: Synthetic peptide
  N-terminus acetylated
LSWAADLQAVVWDTLASGLDKDYLKPDD

SEQ ID NO: 514 - protein, 28 aa, Artificial Sequence
  Description of Artificial Sequence: Synthetic peptide
LSTAADVQAVVWDTLASGLDKDYLKPDD

SEQ ID NO: 515 - protein, 28 aa, Artificial Sequence
  Description of Artificial Sequence: Synthetic peptide
  N-terminus acetylated
LSTAADVQAVVWDTLASGLDKDYLKPDD

SEQ ID NO: 516 - protein, 28 aa, Artificial Sequence
  Description of Artificial Sequence: Synthetic peptide
LSWAADVQAVVWDTLASGLDKDYLKPDD

SEQ ID NO: 517 - protein, 28 aa, Artificial Sequence
  Description of Artificial Sequence: Synthetic peptide
  N-terminus acetylated
LSWAADVQAVVWDTLASGLDKDYLKPDD

SEQ ID NO: 518 - protein, 28 aa, Artificial Sequence
  Description of Artificial Sequence: Synthetic peptide
LSTAADMWAVVWDTLASGLDKDYLKPDD

SEQ ID NO: 519 - protein, 28 aa, Artificial Sequence
  Description of Artificial Sequence: Synthetic peptide
  N-terminus acetylated
LSTAADMWAVVWDTLASGLDKDYLKPDD

SEQ ID NO: 520 - protein, 28 aa, Artificial Sequence
  Description of Artificial Sequence: Synthetic peptide
LSWAADMWAVVWDTLASGLDKDYLKPDD

SEQ ID NO: 521 - protein, 28 aa, Artificial Sequence
  Description of Artificial Sequence: Synthetic peptide
  N-terminus acetylated
LSWAADMWAVVWDTLASGLDKDYLKPDD

SEQ ID NO: 522 - protein, 28 aa, Artificial Sequence
  Description of Artificial Sequence: Synthetic peptide
LSTAADLWAVVWDTLASGLDKDYLKPDD

SEQ ID NO: 523 - protein, 28 aa, Artificial Sequence
  Description of Artificial Sequence: Synthetic peptide
  N-terminus acetylated
LSTAADLWAVVWDTLASGLDKDYLKPDD

SEQ ID NO: 524 - protein, 28 aa, Artificial Sequence
  Description of Artificial Sequence: Synthetic peptide
LSWAADLWAVVWDTLASGLDKDYLKPDD

SEQ ID NO: 525 - protein, 28 aa, Artificial Sequence
  Description of Artificial Sequence: Synthetic peptide
  N-terminus acetylated
LSWAADLWAVVWDTLASGLDKDYLKPDD

SEQ ID NO: 526 - protein, 28 aa, Artificial Sequence
  Description of Artificial Sequence: Synthetic peptide
LSTAADVWAVVWDTLASGLDKDYLKPDD

SEQ ID NO: 527 - protein, 28 aa, Artificial Sequence
  Description of Artificial Sequence: Synthetic peptide
  N-terminus acetylated
LSTAADVWAVVWDTLASGLDKDYLKPDD

SEQ ID NO: 528 - protein, 28 aa, Artificial Sequence
  Description of Artificial Sequence: Synthetic peptide
LSWAADVWAVVWDTLASGLDKDYLKPDD

SEQ ID NO: 529 - protein, 28 aa, Artificial Sequence
  Description of Artificial Sequence: Synthetic peptide
  N-terminus acetylated
LSWAADVWAVVWDTLASGLDKDYLKPDD

SEQ ID NO: 530 - protein, 28 aa, Artificial Sequence
  Description of Artificial Sequence: Synthetic peptide
LSTAADMQGVVTDWLASGLDKDYLKPDD

SEQ ID NO: 531 - protein, 28 aa, Artificial Sequence
  Description of Artificial Sequence: Synthetic peptide
  N-terminus acetylated
LSTAADMQGVVTDWLASGLDKDYLKPDD

SEQ ID NO: 532 - protein, 28 aa, Artificial Sequence
  Description of Artificial Sequence: Synthetic peptide
LSWAADMQGVVTDWLASGLDKDYLKPDD

SEQ ID NO: 533 - protein, 28 aa, Artificial Sequence
  Description of Artificial Sequence: Synthetic peptide
  N-terminus acetylated
LSWAADMQGVVTDWLASGLDKDYLKPDD

SEQ ID NO: 534 - protein, 28 aa, Artificial Sequence
  Description of Artificial Sequence: Synthetic peptide
LSTAADLQGVVTDWLASGLDKDYLKPDD

SEQ ID NO: 535 - protein, 28 aa, Artificial Sequence
  Description of Artificial Sequence: Synthetic peptide
  N-terminus acetylated
LSTAADLQGVVTDWLASGLDKDYLKPDD

SEQ ID NO: 536 - protein, 28 aa, Artificial Sequence
  Description of Artificial Sequence: Synthetic peptide
LSWAADLQGVVTDWLASGLDKDYLKPDD

SEQ ID NO: 537 - protein, 28 aa, Artificial Sequence
  Description of Artificial Sequence: Synthetic peptide
  N-terminus acetylated
LSWAADLQGVVTDWLASGLDKDYLKPDD

SEQ ID NO: 538 - protein, 28 aa, Artificial Sequence
  Description of Artificial Sequence: Synthetic peptide
LSTAADVQGVVTDWLASGLDKDYLKPDD

SEQ ID NO: 539 - protein, 28 aa, Artificial Sequence
  Description of Artificial Sequence: Synthetic peptide
  N-terminus acetylated
LSTAADVQGVVTDWLASGLDKDYLKPDD

SEQ ID NO: 540 - protein, 28 aa, Artificial Sequence
  Description of Artificial Sequence: Synthetic peptide
LSWAADVQGVVTDWLASGLDKDYLKPDD

SEQ ID NO: 541 - protein, 28 aa, Artificial Sequence
  Description of Artificial Sequence: Synthetic peptide
  N-terminus acetylated
LSWAADVQGVVTDWLASGLDKDYLKPDD

SEQ ID NO: 542 - protein, 28 aa, Artificial Sequence
  Description of Artificial Sequence: Synthetic peptide
LSTAADMWGVVTDWLASGLDKDYLKPDD

SEQ ID NO: 543 - protein, 28 aa, Artificial Sequence
  Description of Artificial Sequence: Synthetic peptide
  N-terminus acetylated
LSTAADMWGVVTDWLASGLDKDYLKPDD

SEQ ID NO: 544 - protein, 28 aa, Artificial Sequence
  Description of Artificial Sequence: Synthetic peptide
LSWAADMWGVVTDWLASGLDKDYLKPDD

SEQ ID NO: 545 - protein, 28 aa, Artificial Sequence
  Description of Artificial Sequence: Synthetic peptide
  N-terminus acetylated
LSWAADMWGVVTDWLASGLDKDYLKPDD

SEQ ID NO: 546 - protein, 28 aa, Artificial Sequence
  Description of Artificial Sequence: Synthetic peptide
LSTAADLWGVVTDWLASGLDKDYLKPDD

SEQ ID NO: 547 - protein, 28 aa, Artificial Sequence
  Description of Artificial Sequence: Synthetic peptide
  N-terminus acetylated
LSTAADLWGVVTDWLASGLDKDYLKPDD

SEQ ID NO: 548 - protein, 28 aa, Artificial Sequence
  Description of Artificial Sequence: Synthetic peptide
LSWAADLWGVVTDWLASGLDKDYLKPDD

SEQ ID NO: 549 - protein, 28 aa, Artificial Sequence
  Description of Artificial Sequence: Synthetic peptide
  N-terminus acetylated
LSWAADLWGVVTDWLASGLDKDYLKPDD

SEQ ID NO: 550 - protein, 28 aa, Artificial Sequence
  Description of Artificial Sequence: Synthetic peptide
LSTAADVWGVVTDWLASGLDKDYLKPDD

SEQ ID NO: 551 - protein, 28 aa, Artificial Sequence
  Description of Artificial Sequence: Synthetic peptide
  N-terminus acetylated
LSTAADVWGVVTDWLASGLDKDYLKPDD

SEQ ID NO: 552 - protein, 28 aa, Artificial Sequence
  Description of Artificial Sequence: Synthetic peptide
LSWAADVWGVVTDWLASGLDKDYLKPDD

SEQ ID NO: 553 - protein, 28 aa, Artificial Sequence
  Description of Artificial Sequence: Synthetic peptide
  N-terminus acetylated
LSWAADVWGVVTDWLASGLDKDYLKPDD

SEQ ID NO: 554 - protein, 28 aa, Artificial Sequence
  Description of Artificial Sequence: Synthetic peptide
LSTAADMQAVVTDWLASGLDKDYLKPDD

SEQ ID NO: 555 - protein, 28 aa, Artificial Sequence
  Description of Artificial Sequence: Synthetic peptide
  N-terminus acetylated
LSTAADMQAVVTDWLASGLDKDYLKPDD

SEQ ID NO: 556 - protein, 28 aa, Artificial Sequence
  Description of Artificial Sequence: Synthetic peptide
LSWAADMQAVVTDWLASGLDKDYLKPDD

SEQ ID NO: 557 - protein, 28 aa, Artificial Sequence
  Description of Artificial Sequence: Synthetic peptide
  N-terminus acetylated
LSWAADMQAVVTDWLASGLDKDYLKPDD

SEQ ID NO: 558 - protein, 28 aa, Artificial Sequence
  Description of Artificial Sequence: Synthetic peptide
LSTAADLQAVVTDWLASGLDKDYLKPDD

SEQ ID NO: 559 - protein, 28 aa, Artificial Sequence
  Description of Artificial Sequence: Synthetic peptide
  N-terminus acetylated
LSTAADLQAVVTDWLASGLDKDYLKPDD

SEQ ID NO: 560 - protein, 28 aa, Artificial Sequence
  Description of Artificial Sequence: Synthetic peptide
LSWAADLQAVVTDWLASGLDKDYLKPDD

SEQ ID NO: 561 - protein, 28 aa, Artificial Sequence
  Description of Artificial Sequence: Synthetic peptide
  N-terminus acetylated
LSWAADLQAVVTDWLASGLDKDYLKPDD

SEQ ID NO: 562 - protein, 28 aa, Artificial Sequence
  Description of Artificial Sequence: Synthetic peptide
LSTAADVQAVVTDWLASGLDKDYLKPDD

SEQ ID NO: 563 - protein, 28 aa, Artificial Sequence
  Description of Artificial Sequence: Synthetic peptide
  N-terminus acetylated
LSTAADVQAVVTDWLASGLDKDYLKPDD

SEQ ID NO: 564 - protein, 28 aa, Artificial Sequence
  Description of Artificial Sequence: Synthetic peptide
LSWAADVQAVVTDWLASGLDKDYLKPDD

SEQ ID NO: 565 - protein, 28 aa, Artificial Sequence
  Description of Artificial Sequence: Synthetic peptide
  N-terminus acetylated
LSWAADVQAVVTDWLASGLDKDYLKPDD

SEQ ID NO: 566 - protein, 28 aa, Artificial Sequence
  Description of Artificial Sequence: Synthetic peptide
LSTAADMWAVVTDWLASGLDKDYLKPDD

SEQ ID NO: 567 - protein, 28 aa, Artificial Sequence
  Description of Artificial Sequence: Synthetic peptide
  N-terminus acetylated
LSTAADMWAVVTDWLASGLDKDYLKPDD

SEQ ID NO: 568 - protein, 28 aa, Artificial Sequence
  Description of Artificial Sequence: Synthetic peptide
LSWAADMWAVVTDWLASGLDKDYLKPDD

SEQ ID NO: 569 - protein, 28 aa, Artificial Sequence
  Description of Artificial Sequence: Synthetic peptide
  N-terminus acetylated
LSWAADMWAVVTDWLASGLDKDYLKPDD

SEQ ID NO: 570 - protein, 28 aa, Artificial Sequence
  Description of Artificial Sequence: Synthetic peptide
LSTAADLWAVVTDWLASGLDKDYLKPDD

SEQ ID NO: 571 - protein, 28 aa, Artificial Sequence
  Description of Artificial Sequence: Synthetic peptide
  N-terminus acetylated
LSTAADLWAVVTDWLASGLDKDYLKPDD

SEQ ID NO: 572 - protein, 28 aa, Artificial Sequence
  Description of Artificial Sequence: Synthetic peptide
LSWAADLWAVVTDWLASGLDKDYLKPDD

SEQ ID NO: 573 - protein, 28 aa, Artificial Sequence
  Description of Artificial Sequence: Synthetic peptide
  N-terminus acetylated
LSWAADLWAVVTDWLASGLDKDYLKPDD

SEQ ID NO: 574 - protein, 28 aa, Artificial Sequence
  Description of Artificial Sequence: Synthetic peptide
LSTAADVWAVVTDWLASGLDKDYLKPDD

SEQ ID NO: 575 - protein, 28 aa, Artificial Sequence
  Description of Artificial Sequence: Synthetic peptide
  N-terminus acetylated
LSTAADVWAVVTDWLASGLDKDYLKPDD

SEQ ID NO: 576 - protein, 28 aa, Artificial Sequence
  Description of Artificial Sequence: Synthetic peptide
LSWAADVWAVVTDWLASGLDKDYLKPDD

SEQ ID NO: 577 - protein, 28 aa, Artificial Sequence
  Description of Artificial Sequence: Synthetic peptide
  N-terminus acetylated
LSWAADVWAVVTDWLASGLDKDYLKPDD

SEQ ID NO: 578 - protein, 28 aa, Artificial Sequence
  Description of Artificial Sequence: Synthetic peptide
LSTAADMQGVVWDWLASGLDKDYLKPDD

SEQ ID NO: 579 - protein, 28 aa, Artificial Sequence
  Description of Artificial Sequence: Synthetic peptide
  N-terminus acetylated
LSTAADMQGVVWDWLASGLDKDYLKPDD

SEQ ID NO: 580 - protein, 28 aa, Artificial Sequence
  Description of Artificial Sequence: Synthetic peptide
LSWAADMQGVVWDWLASGLDKDYLKPDD

SEQ ID NO: 581 - protein, 28 aa, Artificial Sequence
  Description of Artificial Sequence: Synthetic peptide
  N-terminus acetylated
LSWAADMQGVVWDWLASGLDKDYLKPDD

SEQ ID NO: 582 - protein, 28 aa, Artificial Sequence
  Description of Artificial Sequence: Synthetic peptide
LSTAADLQGVVWDWLASGLDKDYLKPDD

SEQ ID NO: 583 - protein, 28 aa, Artificial Sequence
  Description of Artificial Sequence: Synthetic peptide
  N-terminus acetylated
LSTAADLQGVVWDWLASGLDKDYLKPDD

SEQ ID NO: 584 - protein, 28 aa, Artificial Sequence
  Description of Artificial Sequence: Synthetic peptide
LSWAADLQGVVWDWLASGLDKDYLKPDD

SEQ ID NO: 585 - protein, 28 aa, Artificial Sequence
  Description of Artificial Sequence: Synthetic peptide
  N-terminus acetylated
LSWAADLQGVVWDWLASGLDKDYLKPDD

SEQ ID NO: 586 - protein, 28 aa, Artificial Sequence
  Description of Artificial Sequence: Synthetic peptide
LSTAADVQGVVWDWLASGLDKDYLKPDD

SEQ ID NO: 587 - protein, 28 aa, Artificial Sequence
  Description of Artificial Sequence: Synthetic peptide
  N-terminus acetylated
LSTAADVQGVVWDWLASGLDKDYLKPDD

SEQ ID NO: 588 - protein, 28 aa, Artificial Sequence
  Description of Artificial Sequence: Synthetic peptide
LSWAADVQGVVWDWLASGLDKDYLKPDD

SEQ ID NO: 589 - protein, 28 aa, Artificial Sequence
  Description of Artificial Sequence: Synthetic peptide
  N-terminus acetylated
LSWAADVQGVVWDWLASGLDKDYLKPDD

SEQ ID NO: 590 - protein, 28 aa, Artificial Sequence
  Description of Artificial Sequence: Synthetic peptide
LSTAADMWGVVWDWLASGLDKDYLKPDD

SEQ ID NO: 591 - protein, 28 aa, Artificial Sequence
  Description of Artificial Sequence: Synthetic peptide
  N-terminus acetylated
LSTAADMWGVVWDWLASGLDKDYLKPDD

SEQ ID NO: 592 - protein, 28 aa, Artificial Sequence
  Description of Artificial Sequence: Synthetic peptide
LSWAADMWGVVWDWLASGLDKDYLKPDD

SEQ ID NO: 593 - protein, 28 aa, Artificial Sequence
  Description of Artificial Sequence: Synthetic peptide
  N-terminus acetylated
LSWAADMWGVVWDWLASGLDKDYLKPDD

SEQ ID NO: 594 - protein, 28 aa, Artificial Sequence
  Description of Artificial Sequence: Synthetic peptide
LSTAADLWGVVWDWLASGLDKDYLKPDD

SEQ ID NO: 595 - protein, 28 aa, Artificial Sequence
  Description of Artificial Sequence: Synthetic peptide
  N-terminus acetylated
LSTAADLWGVVWDWLASGLDKDYLKPDD

SEQ ID NO: 596 - protein, 28 aa, Artificial Sequence
  Description of Artificial Sequence: Synthetic peptide
LSWAADLWGVVWDWLASGLDKDYLKPDD

SEQ ID NO: 597 - protein, 28 aa, Artificial Sequence
  Description of Artificial Sequence: Synthetic peptide
  N-terminus acetylated
LSWAADLWGVVWDWLASGLDKDYLKPDD

SEQ ID NO: 598 - protein, 28 aa, Artificial Sequence
  Description of Artificial Sequence: Synthetic peptide
LSTAADVWGVVWDWLASGLDKDYLKPDD

SEQ ID NO: 599 - protein, 28 aa, Artificial Sequence
  Description of Artificial Sequence: Synthetic peptide
  N-terminus acetylated
LSTAADVWGVVWDWLASGLDKDYLKPDD

SEQ ID NO: 600 - protein, 28 aa, Artificial Sequence
  Description of Artificial Sequence: Synthetic peptide
LSWAADVWGVVWDWLASGLDKDYLKPDD

SEQ ID NO: 601 - protein, 28 aa, Artificial Sequence
  Description of Artificial Sequence: Synthetic peptide
  N-terminus acetylated
LSWAADVWGVVWDWLASGLDKDYLKPDD

SEQ ID NO: 602 - protein, 28 aa, Artificial Sequence
  Description of Artificial Sequence: Synthetic peptide
LSTAADMQAVVWDWLASGLDKDYLKPDD

SEQ ID NO: 603 - protein, 28 aa, Artificial Sequence
  Description of Artificial Sequence: Synthetic peptide
  N-terminus acetylated
LSTAADMQAVVWDWLASGLDKDYLKPDD

SEQ ID NO: 604 - protein, 28 aa, Artificial Sequence
  Description of Artificial Sequence: Synthetic peptide
LSWAADMQAVVWDWLASGLDKDYLKPDD

SEQ ID NO: 605 - protein, 28 aa, Artificial Sequence
  Description of Artificial Sequence: Synthetic peptide
  N-terminus acetylated
LSWAADMQAVVWDWLASGLDKDYLKPDD

SEQ ID NO: 606 - protein, 28 aa, Artificial Sequence
  Description of Artificial Sequence: Synthetic peptide
LSTAADLQAVVWDWLASGLDKDYLKPDD

SEQ ID NO: 607 - protein, 28 aa, Artificial Sequence
  Description of Artificial Sequence: Synthetic peptide
  N-terminus acetylated
LSTAADLQAVVWDWLASGLDKDYLKPDD

SEQ ID NO: 608 - protein, 28 aa, Artificial Sequence
  Description of Artificial Sequence: Synthetic peptide
LSWAADLQAVVWDWLASGLDKDYLKPDD

SEQ ID NO: 609 - protein, 28 aa, Artificial Sequence
  Description of Artificial Sequence: Synthetic peptide
  N-terminus acetylated
LSWAADLQAVVWDWLASGLDKDYLKPDD

SEQ ID NO: 610 - protein, 28 aa, Artificial Sequence
  Description of Artificial Sequence: Synthetic peptide
LSTAADVQAVVWDWLASGLDKDYLKPDD

SEQ ID NO: 611 - protein, 28 aa, Artificial Sequence
  Description of Artificial Sequence: Synthetic peptide
  N-terminus acetylated
LSTAADVQAVVWDWLASGLDKDYLKPDD

SEQ ID NO: 612 - protein, 28 aa, Artificial Sequence
  Description of Artificial Sequence: Synthetic peptide
LSWAADVQAVVWDWLASGLDKDYLKPDD

SEQ ID NO: 613 - protein, 28 aa, Artificial Sequence
  Description of Artificial Sequence: Synthetic peptide
  N-terminus acetylated
LSWAADVQAVVWDWLASGLDKDYLKPDD

SEQ ID NO: 614 - protein, 28 aa, Artificial Sequence
  Description of Artificial Sequence: Synthetic peptide
LSTAADMWAVVWDWLASGLDKDYLKPDD

SEQ ID NO: 615 - protein, 28 aa, Artificial Sequence
  Description of Artificial Sequence: Synthetic peptide
  N-terminus acetylated
LSTAADMWAVVWDWLASGLDKDYLKPDD

SEQ ID NO: 616 - protein, 28 aa, Artificial Sequence
  Description of Artificial Sequence: Synthetic peptide
LSWAADMWAVVWDWLASGLDKDYLKPDD

SEQ ID NO: 617 - protein, 28 aa, Artificial Sequence
  Description of Artificial Sequence: Synthetic peptide
  N-terminus acetylated
LSWAADMWAVVWDWLASGLDKDYLKPDD

SEQ ID NO: 618 - protein, 28 aa, Artificial Sequence
  Description of Artificial Sequence: Synthetic peptide
LSTAADLWAVVWDWLASGLDKDYLKPDD

SEQ ID NO: 619 - protein, 28 aa, Artificial Sequence
  Description of Artificial Sequence: Synthetic peptide
  N-terminus acetylated
LSTAADLWAVVWDWLASGLDKDYLKPDD

SEQ ID NO: 620 - protein, 28 aa, Artificial Sequence
  Description of Artificial Sequence: Synthetic peptide
LSWAADLWAVVWDWLASGLDKDYLKPDD

SEQ ID NO: 621 - protein, 28 aa, Artificial Sequence
  Description of Artificial Sequence: Synthetic peptide
  N-terminus acetylated
LSWAADLWAVVWDWLASGLDKDYLKPDD

SEQ ID NO: 622 - protein, 28 aa, Artificial Sequence
  Description of Artificial Sequence: Synthetic peptide
LSTAADVWAVVWDWLASGLDKDYLKPDD

SEQ ID NO: 623 - protein, 28 aa, Artificial Sequence
  Description of Artificial Sequence: Synthetic peptide
  N-terminus acetylated
LSTAADVWAVVWDWLASGLDKDYLKPDD

SEQ ID NO: 624 - protein, 28 aa, Artificial Sequence
  Description of Artificial Sequence: Synthetic peptide
LSWAADVWAVVWDWLASGLDKDYLKPDD

SEQ ID NO: 625 - protein, 28 aa, Artificial Sequence
  Description of Artificial Sequence: Synthetic peptide
  N-terminus acetylated
LSWAADVWAVVWDWLASGLDKDYLKPDD

SEQ ID NO: 626 - protein, 28 aa, Artificial Sequence
  Description of Artificial Sequence: Synthetic peptide
LSTAADMQGVVTDGVASGLDKDYLKPDD

SEQ ID NO: 627 - protein, 28 aa, Artificial Sequence
  Description of Artificial Sequence: Synthetic peptide
  N-terminus acetylated
LSTAADMQGVVTDGVASGLDKDYLKPDD

SEQ ID NO: 628 - protein, 28 aa, Artificial Sequence
  Description of Artificial Sequence: Synthetic peptide
LSWAADMQGVVTDGVASGLDKDYLKPDD

SEQ ID NO: 629 - protein, 28 aa, Artificial Sequence
  Description of Artificial Sequence: Synthetic peptide
  N-terminus acetylated
LSWAADMQGVVTDGVASGLDKDYLKPDD

SEQ ID NO: 630 - protein, 28 aa, Artificial Sequence
  Description of Artificial Sequence: Synthetic peptide
LSTAADLQGVVTDGVASGLDKDYLKPDD

SEQ ID NO: 631 - protein, 28 aa, Artificial Sequence
  Description of Artificial Sequence: Synthetic peptide
  N-terminus acetylated
LSTAADLQGVVTDGVASGLDKDYLKPDD

SEQ ID NO: 632 - protein, 28 aa, Artificial Sequence
  Description of Artificial Sequence: Synthetic peptide
LSWAADLQGVVTDGVASGLDKDYLKPDD

SEQ ID NO: 633 - protein, 28 aa, Artificial Sequence
  Description of Artificial Sequence: Synthetic peptide
  N-terminus acetylated
LSWAADLQGVVTDGVASGLDKDYLKPDD

SEQ ID NO: 634 - protein, 28 aa, Artificial Sequence
  Description of Artificial Sequence: Synthetic peptide
LSTAADVQGVVTDGVASGLDKDYLKPDD

SEQ ID NO: 635 - protein, 28 aa, Artificial Sequence
  Description of Artificial Sequence: Synthetic peptide
  N-terminus acetylated
LSTAADVQGVVTDGVASGLDKDYLKPDD

SEQ ID NO: 636 - protein, 28 aa, Artificial Sequence
  Description of Artificial Sequence: Synthetic peptide
LSWAADVQGVVTDGVASGLDKDYLKPDD

SEQ ID NO: 637 - protein, 28 aa, Artificial Sequence
  Description of Artificial Sequence: Synthetic peptide
  N-terminus acetylated
LSWAADVQGVVTDGVASGLDKDYLKPDD

SEQ ID NO: 638 - protein, 28 aa, Artificial Sequence
  Description of Artificial Sequence: Synthetic peptide
LSTAADMWGVVTDGVASGLDKDYLKPDD

SEQ ID NO: 639 - protein, 28 aa, Artificial Sequence
  Description of Artificial Sequence: Synthetic peptide
  N-terminus acetylated
LSTAADMWGVVTDGVASGLDKDYLKPDD

SEQ ID NO: 640 - protein, 28 aa, Artificial Sequence
  Description of Artificial Sequence: Synthetic peptide
LSWAADMWGVVTDGVASGLDKDYLKPDD

SEQ ID NO: 641 - protein, 28 aa, Artificial Sequence
  Description of Artificial Sequence: Synthetic peptide
  N-terminus acetylated
LSWAADMWGVVTDGVASGLDKDYLKPDD

SEQ ID NO: 642 - protein, 28 aa, Artificial Sequence
  Description of Artificial Sequence: Synthetic peptide
LSTAADLWGVVTDGVASGLDKDYLKPDD

SEQ ID NO: 643 - protein, 28 aa, Artificial Sequence
  Description of Artificial Sequence: Synthetic peptide
  N-terminus acetylated
LSTAADLWGVVTDGVASGLDKDYLKPDD

SEQ ID NO: 644 - protein, 28 aa, Artificial Sequence
  Description of Artificial Sequence: Synthetic peptide
LSWAADLWGVVTDGVASGLDKDYLKPDD

SEQ ID NO: 645 - protein, 28 aa, Artificial Sequence
  Description of Artificial Sequence: Synthetic peptide
  N-terminus acetylated
LSWAADLWGVVTDGVASGLDKDYLKPDD

SEQ ID NO: 646 - protein, 28 aa, Artificial Sequence
  Description of Artificial Sequence: Synthetic peptide
LSTAADVWGVVTDGVASGLDKDYLKPDD

SEQ ID NO: 647 - protein, 28 aa, Artificial Sequence
  Description of Artificial Sequence: Synthetic peptide
  N-terminus acetylated
LSTAADVWGVVTDGVASGLDKDYLKPDD

SEQ ID NO: 648 - protein, 28 aa, Artificial Sequence
  Description of Artificial Sequence: Synthetic peptide
LSWAADVWGVVTDGVASGLDKDYLKPDD

SEQ ID NO: 649 - protein, 28 aa, Artificial Sequence
  Description of Artificial Sequence: Synthetic peptide
  N-terminus acetylated
LSWAADVWGVVTDGVASGLDKDYLKPDD

SEQ ID NO: 650 - protein, 28 aa, Artificial Sequence
  Description of Artificial Sequence: Synthetic peptide
LSTAADMQAVVTDGVASGLDKDYLKPDD

SEQ ID NO: 651 - protein, 28 aa, Artificial Sequence
  Description of Artificial Sequence: Synthetic peptide
  N-terminus acetylated
LSTAADMQAVVTDGVASGLDKDYLKPDD

SEQ ID NO: 652 - protein, 28 aa, Artificial Sequence
  Description of Artificial Sequence: Synthetic peptide
LSWAADMQAVVTDGVASGLDKDYLKPDD

SEQ ID NO: 653 - protein, 28 aa, Artificial Sequence
  Description of Artificial Sequence: Synthetic peptide
  N-terminus acetylated
LSWAADMQAVVTDGVASGLDKDYLKPDD

SEQ ID NO: 654 - protein, 28 aa, Artificial Sequence
  Description of Artificial Sequence: Synthetic peptide
LSTAADLQAVVTDGVASGLDKDYLKPDD

SEQ ID NO: 655 - protein, 28 aa, Artificial Sequence
  Description of Artificial Sequence: Synthetic peptide
  N-terminus acetylated
LSTAADLQAVVTDGVASGLDKDYLKPDD

SEQ ID NO: 656 - protein, 28 aa, Artificial Sequence
  Description of Artificial Sequence: Synthetic peptide
LSWAADLQAVVTDGVASGLDKDYLKPDD

SEQ ID NO: 657 - protein, 28 aa, Artificial Sequence
  Description of Artificial Sequence: Synthetic peptide
  N-terminus acetylated
LSWAADLQAVVTDGVASGLDKDYLKPDD

SEQ ID NO: 658 - protein, 28 aa, Artificial Sequence
  Description of Artificial Sequence: Synthetic peptide
LSTAADVQAVVTDGVASGLDKDYLKPDD

SEQ ID NO: 659 - protein, 28 aa, Artificial Sequence
  Description of Artificial Sequence: Synthetic peptide
  N-terminus acetylated
LSTAADVQAVVTDGVASGLDKDYLKPDD

SEQ ID NO: 660 - protein, 28 aa, Artificial Sequence
  Description of Artificial Sequence: Synthetic peptide
LSWAADVQAVVTDGVASGLDKDYLKPDD

SEQ ID NO: 661 - protein, 28 aa, Artificial Sequence
  Description of Artificial Sequence: Synthetic peptide
  N-terminus acetylated
LSWAADVQAVVTDGVASGLDKDYLKPDD

SEQ ID NO: 662 - protein, 28 aa, Artificial Sequence
  Description of Artificial Sequence: Synthetic peptide
LSTAADMWAVVTDGVASGLDKDYLKPDD

SEQ ID NO: 663 - protein, 28 aa, Artificial Sequence
  Description of Artificial Sequence: Synthetic peptide
  N-terminus acetylated
LSTAADMWAVVTDGVASGLDKDYLKPDD

SEQ ID NO: 664 - protein, 28 aa, Artificial Sequence
  Description of Artificial Sequence: Synthetic peptide
LSWAADMWAVVTDGVASGLDKDYLKPDD

SEQ ID NO: 665 - protein, 28 aa, Artificial Sequence
  Description of Artificial Sequence: Synthetic peptide
  N-terminus acetylated
LSWAADMWAVVTDGVASGLDKDYLKPDD

SEQ ID NO: 666 - protein, 28 aa, Artificial Sequence
  Description of Artificial Sequence: Synthetic peptide
LSTAADLWAVVTDGVASGLDKDYLKPDD

SEQ ID NO: 667 - protein, 28 aa, Artificial Sequence
  Description of Artificial Sequence: Synthetic peptide
  N-terminus acetylated
LSTAADLWAVVTDGVASGLDKDYLKPDD

SEQ ID NO: 668 - protein, 28 aa, Artificial Sequence
  Description of Artificial Sequence: Synthetic peptide
LSWAADLWAVVTDGVASGLDKDYLKPDD

SEQ ID NO: 669 - protein, 28 aa, Artificial Sequence
  Description of Artificial Sequence: Synthetic peptide
  N-terminus acetylated
LSWAADLWAVVTDGVASGLDKDYLKPDD

SEQ ID NO: 670 - protein, 28 aa, Artificial Sequence
  Description of Artificial Sequence: Synthetic peptide
LSTAADVWAVVTDGVASGLDKDYLKPDD

SEQ ID NO: 671 - protein, 28 aa, Artificial Sequence
  Description of Artificial Sequence: Synthetic peptide
  N-terminus acetylated
LSTAADVWAVVTDGVASGLDKDYLKPDD

SEQ ID NO: 672 - protein, 28 aa, Artificial Sequence
  Description of Artificial Sequence: Synthetic peptide
LSWAADVWAVVTDGVASGLDKDYLKPDD

SEQ ID NO: 673 - protein, 28 aa, Artificial Sequence
  Description of Artificial Sequence: Synthetic peptide
  N-terminus acetylated
LSWAADVWAVVTDGVASGLDKDYLKPDD

SEQ ID NO: 674 - protein, 28 aa, Artificial Sequence
  Description of Artificial Sequence: Synthetic peptide
LSTAADMQGVVWDGVASGLDKDYLKPDD

SEQ ID NO: 675 - protein, 28 aa, Artificial Sequence
  Description of Artificial Sequence: Synthetic peptide
  N-terminus acetylated
LSTAADMQGVVWDGVASGLDKDYLKPDD

SEQ ID NO: 676 - protein, 28 aa, Artificial Sequence
  Description of Artificial Sequence: Synthetic peptide
LSWAADMQGVVWDGVASGLDKDYLKPDD

SEQ ID NO: 677 - protein, 28 aa, Artificial Sequence
  Description of Artificial Sequence: Synthetic peptide
  N-terminus acetylated
LSWAADMQGVVWDGVASGLDKDYLKPDD

SEQ ID NO: 678 - protein, 28 aa, Artificial Sequence
  Description of Artificial Sequence: Synthetic peptide
LSTAADLQGVVWDGVASGLDKDYLKPDD

SEQ ID NO: 679 - protein, 28 aa, Artificial Sequence
  Description of Artificial Sequence: Synthetic peptide
  N-terminus acetylated
LSTAADLQGVVWDGVASGLDKDYLKPDD

SEQ ID NO: 680 - protein, 28 aa, Artificial Sequence
  Description of Artificial Sequence: Synthetic peptide
LSWAADLQGVVWDGVASGLDKDYLKPDD

SEQ ID NO: 681 - protein, 28 aa, Artificial Sequence
  Description of Artificial Sequence: Synthetic peptide
  N-terminus acetylated
LSWAADLQGVVWDGVASGLDKDYLKPDD

SEQ ID NO: 682 - protein, 28 aa, Artificial Sequence
  Description of Artificial Sequence: Synthetic peptide
LSTAADVQGVVWDGVASGLDKDYLKPDD

SEQ ID NO: 683 - protein, 28 aa, Artificial Sequence
  Description of Artificial Sequence: Synthetic peptide
  N-terminus acetylated
LSTAADVQGVVWDGVASGLDKDYLKPDD

SEQ ID NO: 684 - protein, 28 aa, Artificial Sequence
  Description of Artificial Sequence: Synthetic peptide
LSWAADVQGVVWDGVASGLDKDYLKPDD

SEQ ID NO: 685 - protein, 28 aa, Artificial Sequence
  Description of Artificial Sequence: Synthetic peptide
  N-terminus acetylated
LSWAADVQGVVWDGVASGLDKDYLKPDD

SEQ ID NO: 686 - protein, 28 aa, Artificial Sequence
  Description of Artificial Sequence: Synthetic peptide
LSTAADMWGVVWDGVASGLDKDYLKPDD

SEQ ID NO: 687 - protein, 28 aa, Artificial Sequence
  Description of Artificial Sequence: Synthetic peptide
  N-terminus acetylated
LSTAADMWGVVWDGVASGLDKDYLKPDD

SEQ ID NO: 688 - protein, 28 aa, Artificial Sequence
  Description of Artificial Sequence: Synthetic peptide
LSWAADMWGVVWDGVASGLDKDYLKPDD

SEQ ID NO: 689 - protein, 28 aa, Artificial Sequence
  Description of Artificial Sequence: Synthetic peptide
  N-terminus acetylated
LSWAADMWGVVWDGVASGLDKDYLKPDD

SEQ ID NO: 690 - protein, 28 aa, Artificial Sequence
  Description of Artificial Sequence: Synthetic peptide
LSTAADLWGVVWDGVASGLDKDYLKPDD

SEQ ID NO: 691 - protein, 28 aa, Artificial Sequence
  Description of Artificial Sequence: Synthetic peptide
  N-terminus acetylated
LSTAADLWGVVWDGVASGLDKDYLKPDD

SEQ ID NO: 692 - protein, 28 aa, Artificial Sequence
  Description of Artificial Sequence: Synthetic peptide
LSWAADLWGVVWDGVASGLDKDYLKPDD

SEQ ID NO: 693 - protein, 28 aa, Artificial Sequence
  Description of Artificial Sequence: Synthetic peptide
  N-terminus acetylated
LSWAADLWGVVWDGVASGLDKDYLKPDD

SEQ ID NO: 694 - protein, 28 aa, Artificial Sequence
  Description of Artificial Sequence: Synthetic peptide
LSTAADVWGVVWDGVASGLDKDYLKPDD

SEQ ID NO: 695 - protein, 28 aa, Artificial Sequence
  Description of Artificial Sequence: Synthetic peptide
  N-terminus acetylated
LSTAADVWGVVWDGVASGLDKDYLKPDD

SEQ ID NO: 696 - protein, 28 aa, Artificial Sequence
  Description of Artificial Sequence: Synthetic peptide
LSWAADVWGVVWDGVASGLDKDYLKPDD

SEQ ID NO: 697 - protein, 28 aa, Artificial Sequence
  Description of Artificial Sequence: Synthetic peptide
  N-terminus acetylated
LSWAADVWGVVWDGVASGLDKDYLKPDD

SEQ ID NO: 698 - protein, 28 aa, Artificial Sequence
  Description of Artificial Sequence: Synthetic peptide
LSTAADMQAVVWDGVASGLDKDYLKPDD

SEQ ID NO: 699 - protein, 28 aa, Artificial Sequence
  Description of Artificial Sequence: Synthetic peptide
  N-terminus acetylated
LSTAADMQAVVWDGVASGLDKDYLKPDD

SEQ ID NO: 700 - protein, 28 aa, Artificial Sequence
  Description of Artificial Sequence: Synthetic peptide
LSWAADMQAVVWDGVASGLDKDYLKPDD

SEQ ID NO: 701 - protein, 28 aa, Artificial Sequence
  Description of Artificial Sequence: Synthetic peptide
  N-terminus acetylated
LSWAADMQAVVWDGVASGLDKDYLKPDD

SEQ ID NO: 702 - protein, 28 aa, Artificial Sequence
  Description of Artificial Sequence: Synthetic peptide
LSTAADLQAVVWDGVASGLDKDYLKPDD

SEQ ID NO: 703 - protein, 28 aa, Artificial Sequence
  Description of Artificial Sequence: Synthetic peptide
  N-terminus acetylated
LSTAADLQAVVWDGVASGLDKDYLKPDD

SEQ ID NO: 704 - protein, 28 aa, Artificial Sequence
  Description of Artificial Sequence: Synthetic peptide
LSWAADLQAVVWDGVASGLDKDYLKPDD

SEQ ID NO: 705 - protein, 28 aa, Artificial Sequence
  Description of Artificial Sequence: Synthetic peptide
  N-terminus acetylated
LSWAADLQAVVWDGVASGLDKDYLKPDD

SEQ ID NO: 706 - protein, 28 aa, Artificial Sequence
  Description of Artificial Sequence: Synthetic peptide
LSTAADVQAVVWDGVASGLDKDYLKPDD

SEQ ID NO: 707 - protein, 28 aa, Artificial Sequence
  Description of Artificial Sequence: Synthetic peptide
  N-terminus acetylated
LSTAADVQAVVWDGVASGLDKDYLKPDD

SEQ ID NO: 708 - protein, 28 aa, Artificial Sequence
  Description of Artificial Sequence: Synthetic peptide
LSWAADVQAVVWDGVASGLDKDYLKPDD

SEQ ID NO: 709 - protein, 28 aa, Artificial Sequence
  Description of Artificial Sequence: Synthetic peptide
  N-terminus acetylated
LSWAADVQAVVWDGVASGLDKDYLKPDD

SEQ ID NO: 710 - protein, 28 aa, Artificial Sequence
  Description of Artificial Sequence: Synthetic peptide
LSTAADMWAVVWDGVASGLDKDYLKPDD

SEQ ID NO: 711 - protein, 28 aa, Artificial Sequence
  Description of Artificial Sequence: Synthetic peptide
  N-terminus acetylated
LSTAADMWAVVWDGVASGLDKDYLKPDD

SEQ ID NO: 712 - protein, 28 aa, Artificial Sequence
  Description of Artificial Sequence: Synthetic peptide
LSWAADMWAVVWDGVASGLDKDYLKPDD

SEQ ID NO: 713 - protein, 28 aa, Artificial Sequence
  Description of Artificial Sequence: Synthetic peptide
  N-terminus acetylated
LSWAADMWAVVWDGVASGLDKDYLKPDD

SEQ ID NO: 714 - protein, 28 aa, Artificial Sequence
  Description of Artificial Sequence: Synthetic peptide
LSTAADLWAVVWDGVASGLDKDYLKPDD

SEQ ID NO: 715 - protein, 28 aa, Artificial Sequence
  Description of Artificial Sequence: Synthetic peptide
  N-terminus acetylated
LSTAADLWAVVWDGVASGLDKDYLKPDD

SEQ ID NO: 716 - protein, 28 aa, Artificial Sequence
  Description of Artificial Sequence: Synthetic peptide
LSWAADLWAVVWDGVASGLDKDYLKPDD

SEQ ID NO: 717 - protein, 28 aa, Artificial Sequence
  Description of Artificial Sequence: Synthetic peptide
  N-terminus acetylated
LSWAADLWAVVWDGVASGLDKDYLKPDD

SEQ ID NO: 718 - protein, 28 aa, Artificial Sequence
  Description of Artificial Sequence: Synthetic peptide
LSTAADVWAVVWDGVASGLDKDYLKPDD

SEQ ID NO: 719 - protein, 28 aa, Artificial Sequence
  Description of Artificial Sequence: Synthetic peptide
  N-terminus acetylated
LSTAADVWAVVWDGVASGLDKDYLKPDD

SEQ ID NO: 720 - protein, 28 aa, Artificial Sequence
  Description of Artificial Sequence: Synthetic peptide
LSWAADVWAVVWDGVASGLDKDYLKPDD

SEQ ID NO: 721 - protein, 28 aa, Artificial Sequence
  Description of Artificial Sequence: Synthetic peptide
  N-terminus acetylated
LSWAADVWAVVWDGVASGLDKDYLKPDD

SEQ ID NO: 722 - protein, 28 aa, Artificial Sequence
  Description of Artificial Sequence: Synthetic peptide
LSTAADMQGVVTDTVASGLDKDYLKPDD

SEQ ID NO: 723 - protein, 28 aa, Artificial Sequence
  Description of Artificial Sequence: Synthetic peptide
  N-terminus acetylated
LSTAADMQGVVTDTVASGLDKDYLKPDD

SEQ ID NO: 724 - protein, 28 aa, Artificial Sequence
  Description of Artificial Sequence: Synthetic peptide
LSWAADMQGVVTDTVASGLDKDYLKPDD

SEQ ID NO: 725 - protein, 28 aa, Artificial Sequence
  Description of Artificial Sequence: Synthetic peptide
  N-terminus acetylated
LSWAADMQGVVTDTVASGLDKDYLKPDD

SEQ ID NO: 726 - protein, 28 aa, Artificial Sequence
  Description of Artificial Sequence: Synthetic peptide
LSTAADLQGVVTDTVASGLDKDYLKPDD

SEQ ID NO: 727 - protein, 28 aa, Artificial Sequence
  Description of Artificial Sequence: Synthetic peptide
  N-terminus acetylated
LSTAADLQGVVTDTVASGLDKDYLKPDD

SEQ ID NO: 728 - protein, 28 aa, Artificial Sequence
  Description of Artificial Sequence: Synthetic peptide
LSWAADLQGVVTDTVASGLDKDYLKPDD

SEQ ID NO: 729 - protein, 28 aa, Artificial Sequence
  Description of Artificial Sequence: Synthetic peptide
  N-terminus acetylated
LSWAADLQGVVTDTVASGLDKDYLKPDD

SEQ ID NO: 730 - protein, 28 aa, Artificial Sequence
  Description of Artificial Sequence: Synthetic peptide
LSTAADVQGVVTDTVASGLDKDYLKPDD

SEQ ID NO: 731 - protein, 28 aa, Artificial Sequence
  Description of Artificial Sequence: Synthetic peptide
  N-terminus acetylated
LSTAADVQGVVTDTVASGLDKDYLKPDD

SEQ ID NO: 732 - protein, 28 aa, Artificial Sequence
  Description of Artificial Sequence: Synthetic peptide
LSWAADVQGVVTDTVASGLDKDYLKPDD

SEQ ID NO: 733 - protein, 28 aa, Artificial Sequence
  Description of Artificial Sequence: Synthetic peptide
  N-terminus acetylated
LSWAADVQGVVTDTVASGLDKDYLKPDD

SEQ ID NO: 734 - protein, 28 aa, Artificial Sequence
  Description of Artificial Sequence: Synthetic peptide
LSTAADMWGVVTDTVASGLDKDYLKPDD

SEQ ID NO: 735 - protein, 28 aa, Artificial Sequence
  Description of Artificial Sequence: Synthetic peptide
  N-terminus acetylated
LSTAADMWGVVTDTVASGLDKDYLKPDD

SEQ ID NO: 736 - protein, 28 aa, Artificial Sequence
  Description of Artificial Sequence: Synthetic peptide
LSWAADMWGVVTDTVASGLDKDYLKPDD

SEQ ID NO: 737 - protein, 28 aa, Artificial Sequence
  Description of Artificial Sequence: Synthetic peptide
  N-terminus acetylated
LSWAADMWGVVTDTVASGLDKDYLKPDD

SEQ ID NO: 738 - protein, 28 aa, Artificial Sequence
  Description of Artificial Sequence: Synthetic peptide
LSTAADLWGVVTDTVASGLDKDYLKPDD

SEQ ID NO: 739 - protein, 28 aa, Artificial Sequence
  Description of Artificial Sequence: Synthetic peptide
  N-terminus acetylated
LSTAADLWGVVTDTVASGLDKDYLKPDD

SEQ ID NO: 740 - protein, 28 aa, Artificial Sequence
  Description of Artificial Sequence: Synthetic peptide
LSWAADLWGVVTDTVASGLDKDYLKPDD

SEQ ID NO: 741 - protein, 28 aa, Artificial Sequence
  Description of Artificial Sequence: Synthetic peptide
  N-terminus acetylated
LSWAADLWGVVTDTVASGLDKDYLKPDD

SEQ ID NO: 742 - protein, 28 aa, Artificial Sequence
  Description of Artificial Sequence: Synthetic peptide
LSTAADVWGVVTDTVASGLDKDYLKPDD

SEQ ID NO: 743 - protein, 28 aa, Artificial Sequence
  Description of Artificial Sequence: Synthetic peptide
  N-terminus acetylated
LSTAADVWGVVTDTVASGLDKDYLKPDD

SEQ ID NO: 744 - protein, 28 aa, Artificial Sequence
  Description of Artificial Sequence: Synthetic peptide
LSWAADVWGVVTDTVASGLDKDYLKPDD

SEQ ID NO: 745 - protein, 28 aa, Artificial Sequence
  Description of Artificial Sequence: Synthetic peptide
  N-terminus acetylated
LSWAADVWGVVTDTVASGLDKDYLKPDD

SEQ ID NO: 746 - protein, 28 aa, Artificial Sequence
  Description of Artificial Sequence: Synthetic peptide
LSTAADMQAVVTDTVASGLDKDYLKPDD

SEQ ID NO: 747 - protein, 28 aa, Artificial Sequence
  Description of Artificial Sequence: Synthetic peptide
  N-terminus acetylated
LSTAADMQAVVTDTVASGLDKDYLKPDD

SEQ ID NO: 748 - protein, 28 aa, Artificial Sequence
  Description of Artificial Sequence: Synthetic peptide
LSWAADMQAVVTDTVASGLDKDYLKPDD

SEQ ID NO: 749 - protein, 28 aa, Artificial Sequence
  Description of Artificial Sequence: Synthetic peptide
  N-terminus acetylated
LSWAADMQAVVTDTVASGLDKDYLKPDD

SEQ ID NO: 750 - protein, 28 aa, Artificial Sequence
  Description of Artificial Sequence: Synthetic peptide
LSTAADLQAVVTDTVASGLDKDYLKPDD

SEQ ID NO: 751 - protein, 28 aa, Artificial Sequence
  Description of Artificial Sequence: Synthetic peptide
  N-terminus acetylated
LSTAADLQAVVTDTVASGLDKDYLKPDD

SEQ ID NO: 752 - protein, 28 aa, Artificial Sequence
  Description of Artificial Sequence: Synthetic peptide
LSWAADLQAVVTDTVASGLDKDYLKPDD

SEQ ID NO: 753 - protein, 28 aa, Artificial Sequence
  Description of Artificial Sequence: Synthetic peptide
  N-terminus acetylated
LSWAADLQAVVTDTVASGLDKDYLKPDD

SEQ ID NO: 754 - protein, 28 aa, Artificial Sequence
  Description of Artificial Sequence: Synthetic peptide
LSTAADVQAVVTDTVASGLDKDYLKPDD

SEQ ID NO: 755 - protein, 28 aa, Artificial Sequence
  Description of Artificial Sequence: Synthetic peptide
  N-terminus acetylated
LSTAADVQAVVTDTVASGLDKDYLKPDD

SEQ ID NO: 756 - protein, 28 aa, Artificial Sequence
  Description of Artificial Sequence: Synthetic peptide
LSWAADVQAVVTDTVASGLDKDYLKPDD

SEQ ID NO: 757 - protein, 28 aa, Artificial Sequence
  Description of Artificial Sequence: Synthetic peptide
  N-terminus acetylated
LSWAADVQAVVTDTVASGLDKDYLKPDD

SEQ ID NO: 758 - protein, 28 aa, Artificial Sequence
  Description of Artificial Sequence: Synthetic peptide
LSTAADMWAVVTDTVASGLDKDYLKPDD

SEQ ID NO: 759 - protein, 28 aa, Artificial Sequence
  Description of Artificial Sequence: Synthetic peptide
  N-terminus acetylated
LSTAADMWAVVTDTVASGLDKDYLKPDD

SEQ ID NO: 760 - protein, 28 aa, Artificial Sequence
  Description of Artificial Sequence: Synthetic peptide
LSWAADMWAVVTDTVASGLDKDYLKPDD

SEQ ID NO: 761 - protein, 28 aa, Artificial Sequence
  Description of Artificial Sequence: Synthetic peptide
  N-terminus acetylated
LSWAADMWAVVTDTVASGLDKDYLKPDD

SEQ ID NO: 762 - protein, 28 aa, Artificial Sequence
  Description of Artificial Sequence: Synthetic peptide
LSTAADLWAVVTDTVASGLDKDYLKPDD

SEQ ID NO: 763 - protein, 28 aa, Artificial Sequence
  Description of Artificial Sequence: Synthetic peptide
  N-terminus acetylated
LSTAADLWAVVTDTVASGLDKDYLKPDD

SEQ ID NO: 764 - protein, 28 aa, Artificial Sequence
  Description of Artificial Sequence: Synthetic peptide
LSWAADLWAVVTDTVASGLDKDYLKPDD

SEQ ID NO: 765 - protein, 28 aa, Artificial Sequence
  Description of Artificial Sequence: Synthetic peptide
  N-terminus acetylated
LSWAADLWAVVTDTVASGLDKDYLKPDD

SEQ ID NO: 766 - protein, 28 aa, Artificial Sequence
  Description of Artificial Sequence: Synthetic peptide
LSTAADVWAVVTDTVASGLDKDYLKPDD

SEQ ID NO: 767 - protein, 28 aa, Artificial Sequence
  Description of Artificial Sequence: Synthetic peptide
  N-terminus acetylated
LSTAADVWAVVTDTVASGLDKDYLKPDD

SEQ ID NO: 768 - protein, 28 aa, Artificial Sequence
  Description of Artificial Sequence: Synthetic peptide
LSWAADVWAVVTDTVASGLDKDYLKPDD

SEQ ID NO: 769 - protein, 28 aa, Artificial Sequence
  Description of Artificial Sequence: Synthetic peptide
  N-terminus acetylated
LSWAADVWAVVTDTVASGLDKDYLKPDD

SEQ ID NO: 770 - protein, 28 aa, Artificial Sequence
  Description of Artificial Sequence: Synthetic peptide
LSTAADMQGVVWDTVASGLDKDYLKPDD

SEQ ID NO: 771 - protein, 28 aa, Artificial Sequence
  Description of Artificial Sequence: Synthetic peptide
  N-terminus acetylated
LSTAADMQGVVWDTVASGLDKDYLKPDD

SEQ ID NO: 772 - protein, 28 aa, Artificial Sequence
  Description of Artificial Sequence: Synthetic peptide
LSWAADMQGVVWDTVASGLDKDYLKPDD

SEQ ID NO: 773 - protein, 28 aa, Artificial Sequence
  Description of Artificial Sequence: Synthetic peptide
  N-terminus acetylated
LSWAADMQGVVWDTVASGLDKDYLKPDD

SEQ ID NO: 774 - protein, 28 aa, Artificial Sequence
  Description of Artificial Sequence: Synthetic peptide
LSTAADLQGVVWDTVASGLDKDYLKPDD

SEQ ID NO: 775 - protein, 28 aa, Artificial Sequence
  Description of Artificial Sequence: Synthetic peptide
  N-terminus acetylated
LSTAADLQGVVWDTVASGLDKDYLKPDD

SEQ ID NO: 776 - protein, 28 aa, Artificial Sequence
  Description of Artificial Sequence: Synthetic peptide
LSWAADLQGVVWDTVASGLDKDYLKPDD

SEQ ID NO: 777 - protein, 28 aa, Artificial Sequence
  Description of Artificial Sequence: Synthetic peptide
  N-terminus acetylated
LSWAADLQGVVWDTVASGLDKDYLKPDD

SEQ ID NO: 778 - protein, 28 aa, Artificial Sequence
  Description of Artificial Sequence: Synthetic peptide
LSTAADVQGVVWDTVASGLDKDYLKPDD

SEQ ID NO: 779 - protein, 28 aa, Artificial Sequence
  Description of Artificial Sequence: Synthetic peptide
  N-terminus acetylated
LSTAADVQGVVWDTVASGLDKDYLKPDD

SEQ ID NO: 780 - protein, 28 aa, Artificial Sequence
  Description of Artificial Sequence: Synthetic peptide
LSWAADVQGVVWDTVASGLDKDYLKPDD

SEQ ID NO: 781 - protein, 28 aa, Artificial Sequence
  Description of Artificial Sequence: Synthetic peptide
  N-terminus acetylated
LSWAADVQGVVWDTVASGLDKDYLKPDD

SEQ ID NO: 782 - protein, 28 aa, Artificial Sequence
  Description of Artificial Sequence: Synthetic peptide
LSTAADMWGVVWDTVASGLDKDYLKPDD

SEQ ID NO: 783 - protein, 28 aa, Artificial Sequence
  Description of Artificial Sequence: Synthetic peptide
  N-terminus acetylated
LSTAADMWGVVWDTVASGLDKDYLKPDD

SEQ ID NO: 784 - protein, 28 aa, Artificial Sequence
  Description of Artificial Sequence: Synthetic peptide
LSWAADMWGVVWDTVASGLDKDYLKPDD

SEQ ID NO: 785 - protein, 28 aa, Artificial Sequence
  Description of Artificial Sequence: Synthetic peptide
  N-terminus acetylated
LSWAADMWGVVWDTVASGLDKDYLKPDD

SEQ ID NO: 786 - protein, 28 aa, Artificial Sequence
  Description of Artificial Sequence: Synthetic peptide
LSTAADLWGVVWDTVASGLDKDYLKPDD

SEQ ID NO: 787 - protein, 28 aa, Artificial Sequence
  Description of Artificial Sequence: Synthetic peptide
  N-terminus acetylated
LSTAADLWGVVWDTVASGLDKDYLKPDD

SEQ ID NO: 788 - protein, 28 aa, Artificial Sequence
  Description of Artificial Sequence: Synthetic peptide
LSWAADLWGVVWDTVASGLDKDYLKPDD

SEQ ID NO: 789 - protein, 28 aa, Artificial Sequence
  Description of Artificial Sequence: Synthetic peptide
  N-terminus acetylated
LSWAADLWGVVWDTVASGLDKDYLKPDD

SEQ ID NO: 790 - protein, 28 aa, Artificial Sequence
  Description of Artificial Sequence: Synthetic peptide
LSTAADVWGVVWDTVASGLDKDYLKPDD

SEQ ID NO: 791 - protein, 28 aa, Artificial Sequence
  Description of Artificial Sequence: Synthetic peptide
  N-terminus acetylated
LSTAADVWGVVWDTVASGLDKDYLKPDD

SEQ ID NO: 792 - protein, 28 aa, Artificial Sequence
  Description of Artificial Sequence: Synthetic peptide
LSWAADVWGVVWDTVASGLDKDYLKPDD

SEQ ID NO: 793 - protein, 28 aa, Artificial Sequence
  Description of Artificial Sequence: Synthetic peptide
  N-terminus acetylated
LSWAADVWGVVWDTVASGLDKDYLKPDD

SEQ ID NO: 794 - protein, 28 aa, Artificial Sequence
  Description of Artificial Sequence: Synthetic peptide
LSTAADMQAVVWDTVASGLDKDYLKPDD

SEQ ID NO: 795 - protein, 28 aa, Artificial Sequence
  Description of Artificial Sequence: Synthetic peptide
  N-terminus acetylated
LSTAADMQAVVWDTVASGLDKDYLKPDD

SEQ ID NO: 796 - protein, 28 aa, Artificial Sequence
  Description of Artificial Sequence: Synthetic peptide
LSWAADMQAVVWDTVASGLDKDYLKPDD

SEQ ID NO: 797 - protein, 28 aa, Artificial Sequence
  Description of Artificial Sequence: Synthetic peptide
  N-terminus acetylated
LSWAADMQAVVWDTVASGLDKDYLKPDD

SEQ ID NO: 798 - protein, 28 aa, Artificial Sequence
  Description of Artificial Sequence: Synthetic peptide
LSTAADLQAVVWDTVASGLDKDYLKPDD

SEQ ID NO: 799 - protein, 28 aa, Artificial Sequence
  Description of Artificial Sequence: Synthetic peptide
  N-terminus acetylated
LSTAADLQAVVWDTVASGLDKDYLKPDD

SEQ ID NO: 800 - protein, 28 aa, Artificial Sequence
  Description of Artificial Sequence: Synthetic peptide
LSWAADLQAVVWDTVASGLDKDYLKPDD

SEQ ID NO: 801 - protein, 28 aa, Artificial Sequence
  Description of Artificial Sequence: Synthetic peptide
  N-terminus acetylated
LSWAADLQAVVWDTVASGLDKDYLKPDD

SEQ ID NO: 802 - protein, 28 aa, Artificial Sequence
  Description of Artificial Sequence: Synthetic peptide
LSTAADVQAVVWDTVASGLDKDYLKPDD

SEQ ID NO: 803 - protein, 28 aa, Artificial Sequence
  Description of Artificial Sequence: Synthetic peptide
  N-terminus acetylated
LSTAADVQAVVWDTVASGLDKDYLKPDD

SEQ ID NO: 804 - protein, 28 aa, Artificial Sequence
  Description of Artificial Sequence: Synthetic peptide
LSWAADVQAVVWDTVASGLDKDYLKPDD

SEQ ID NO: 805 - protein, 28 aa, Artificial Sequence
  Description of Artificial Sequence: Synthetic peptide
  N-terminus acetylated
LSWAADVQAVVWDTVASGLDKDYLKPDD

SEQ ID NO: 806 - protein, 28 aa, Artificial Sequence
  Description of Artificial Sequence: Synthetic peptide
LSTAADMWAVVWDTVASGLDKDYLKPDD

SEQ ID NO: 807 - protein, 28 aa, Artificial Sequence
  Description of Artificial Sequence: Synthetic peptide
  N-terminus acetylated
LSTAADMWAVVWDTVASGLDKDYLKPDD

SEQ ID NO: 808 - protein, 28 aa, Artificial Sequence
  Description of Artificial Sequence: Synthetic peptide
LSWAADMWAVVWDTVASGLDKDYLKPDD

SEQ ID NO: 809 - protein, 28 aa, Artificial Sequence
  Description of Artificial Sequence: Synthetic peptide
  N-terminus acetylated
LSWAADMWAVVWDTVASGLDKDYLKPDD

SEQ ID NO: 810 - protein, 28 aa, Artificial Sequence
  Description of Artificial Sequence: Synthetic peptide
LSTAADLWAVVWDTVASGLDKDYLKPDD

SEQ ID NO: 811 - protein, 28 aa, Artificial Sequence
  Description of Artificial Sequence: Synthetic peptide
  N-terminus acetylated
LSTAADLWAVVWDTVASGLDKDYLKPDD

SEQ ID NO: 812 - protein, 28 aa, Artificial Sequence
  Description of Artificial Sequence: Synthetic peptide
LSWAADLWAVVWDTVASGLDKDYLKPDD

SEQ ID NO: 813 - protein, 28 aa, Artificial Sequence
  Description of Artificial Sequence: Synthetic peptide
  N-terminus acetylated
LSWAADLWAVVWDTVASGLDKDYLKPDD

SEQ ID NO: 814 - protein, 28 aa, Artificial Sequence
  Description of Artificial Sequence: Synthetic peptide
LSTAADVWAVVWDTVASGLDKDYLKPDD

SEQ ID NO: 815 - protein, 28 aa, Artificial Sequence
  Description of Artificial Sequence: Synthetic peptide
  N-terminus acetylated
LSTAADVWAVVWDTVASGLDKDYLKPDD

SEQ ID NO: 816 - protein, 28 aa, Artificial Sequence
  Description of Artificial Sequence: Synthetic peptide
LSWAADVWAVVWDTVASGLDKDYLKPDD

SEQ ID NO: 817 - protein, 28 aa, Artificial Sequence
  Description of Artificial Sequence: Synthetic peptide
  N-terminus acetylated
LSWAADVWAVVWDTVASGLDKDYLKPDD

SEQ ID NO: 818 - protein, 28 aa, Artificial Sequence
  Description of Artificial Sequence: Synthetic peptide
LSTAADMQGVVTDWVASGLDKDYLKPDD

SEQ ID NO: 819 - protein, 28 aa, Artificial Sequence
  Description of Artificial Sequence: Synthetic peptide
  N-terminus acetylated
LSTAADMQGVVTDWVASGLDKDYLKPDD

SEQ ID NO: 820 - protein, 28 aa, Artificial Sequence
  Description of Artificial Sequence: Synthetic peptide
LSWAADMQGVVTDWVASGLDKDYLKPDD

SEQ ID NO: 821 - protein, 28 aa, Artificial Sequence
  Description of Artificial Sequence: Synthetic peptide
  N-terminus acetylated
LSWAADMQGVVTDWVASGLDKDYLKPDD

SEQ ID NO: 822 - protein, 28 aa, Artificial Sequence
  Description of Artificial Sequence: Synthetic peptide
LSTAADLQGVVTDWVASGLDKDYLKPDD

SEQ ID NO: 823 - protein, 28 aa, Artificial Sequence
  Description of Artificial Sequence: Synthetic peptide
  N-terminus acetylated
LSTAADLQGVVTDWVASGLDKDYLKPDD

SEQ ID NO: 824 - protein, 28 aa, Artificial Sequence
  Description of Artificial Sequence: Synthetic peptide
LSWAADLQGVVTDWVASGLDKDYLKPDD

SEQ ID NO: 825 - protein, 28 aa, Artificial Sequence
  Description of Artificial Sequence: Synthetic peptide
  N-terminus acetylated
LSWAADLQGVVTDWVASGLDKDYLKPDD

SEQ ID NO: 826 - protein, 28 aa, Artificial Sequence
  Description of Artificial Sequence: Synthetic peptide
LSTAADVQGVVTDWVASGLDKDYLKPDD

SEQ ID NO: 827 - protein, 28 aa, Artificial Sequence
  Description of Artificial Sequence: Synthetic peptide
  N-terminus acetylated
LSTAADVQGVVTDWVASGLDKDYLKPDD

SEQ ID NO: 828 - protein, 28 aa, Artificial Sequence
  Description of Artificial Sequence: Synthetic peptide
LSWAADVQGVVTDWVASGLDKDYLKPDD

SEQ ID NO: 829 - protein, 28 aa, Artificial Sequence
  Description of Artificial Sequence: Synthetic peptide
  N-terminus acetylated
LSWAADVQGVVTDWVASGLDKDYLKPDD

SEQ ID NO: 830 - protein, 28 aa, Artificial Sequence
  Description of Artificial Sequence: Synthetic peptide
LSTAADMWGVVTDWVASGLDKDYLKPDD

SEQ ID NO: 831 - protein, 28 aa, Artificial Sequence
  Description of Artificial Sequence: Synthetic peptide
  N-terminus acetylated
LSTAADMWGVVTDWVASGLDKDYLKPDD

SEQ ID NO: 832 - protein, 28 aa, Artificial Sequence
  Description of Artificial Sequence: Synthetic peptide
LSWAADMWGVVTDWVASGLDKDYLKPDD

SEQ ID NO: 833 - protein, 28 aa, Artificial Sequence
  Description of Artificial Sequence: Synthetic peptide
  N-terminus acetylated
LSWAADMWGVVTDWVASGLDKDYLKPDD

SEQ ID NO: 834 - protein, 28 aa, Artificial Sequence
  Description of Artificial Sequence: Synthetic peptide
LSTAADLWGVVTDWVASGLDKDYLKPDD

SEQ ID NO: 835 - protein, 28 aa, Artificial Sequence
  Description of Artificial Sequence: Synthetic peptide
  N-terminus acetylated
LSTAADLWGVVTDWVASGLDKDYLKPDD

SEQ ID NO: 836 - protein, 28 aa, Artificial Sequence
  Description of Artificial Sequence: Synthetic peptide
LSWAADLWGVVTDWVASGLDKDYLKPDD

SEQ ID NO: 837 - protein, 28 aa, Artificial Sequence
  Description of Artificial Sequence: Synthetic peptide
  N-terminus acetylated
LSWAADLWGVVTDWVASGLDKDYLKPDD

SEQ ID NO: 838 - protein, 28 aa, Artificial Sequence
  Description of Artificial Sequence: Synthetic peptide
LSTAADVWGVVTDWVASGLDKDYLKPDD

SEQ ID NO: 839 - protein, 28 aa, Artificial Sequence
  Description of Artificial Sequence: Synthetic peptide
  N-terminus acetylated
LSTAADVWGVVTDWVASGLDKDYLKPDD

SEQ ID NO: 840 - protein, 28 aa, Artificial Sequence
  Description of Artificial Sequence: Synthetic peptide
LSWAADVWGVVTDWVASGLDKDYLKPDD

SEQ ID NO: 841 - protein, 28 aa, Artificial Sequence
  Description of Artificial Sequence: Synthetic peptide
  N-terminus acetylated
LSWAADVWGVVTDWVASGLDKDYLKPDD

SEQ ID NO: 842 - protein, 28 aa, Artificial Sequence
  Description of Artificial Sequence: Synthetic peptide
LSTAADMQAVVTDWVASGLDKDYLKPDD

SEQ ID NO: 843 - protein, 28 aa, Artificial Sequence
  Description of Artificial Sequence: Synthetic peptide
  N-terminus acetylated
LSTAADMQAVVTDWVASGLDKDYLKPDD

SEQ ID NO: 844 - protein, 28 aa, Artificial Sequence
  Description of Artificial Sequence: Synthetic peptide
LSWAADMQAVVTDWVASGLDKDYLKPDD

SEQ ID NO: 845 - protein, 28 aa, Artificial Sequence
  Description of Artificial Sequence: Synthetic peptide
  N-terminus acetylated
LSWAADMQAVVTDWVASGLDKDYLKPDD

SEQ ID NO: 846 - protein, 28 aa, Artificial Sequence
  Description of Artificial Sequence: Synthetic peptide
LSTAADLQAVVTDWVASGLDKDYLKPDD

SEQ ID NO: 847 - protein, 28 aa, Artificial Sequence
  Description of Artificial Sequence: Synthetic peptide
  N-terminus acetylated
LSTAADLQAVVTDWVASGLDKDYLKPDD

SEQ ID NO: 848 - protein, 28 aa, Artificial Sequence
  Description of Artificial Sequence: Synthetic peptide
LSWAADLQAVVTDWVASGLDKDYLKPDD

SEQ ID NO: 849 - protein, 28 aa, Artificial Sequence
  Description of Artificial Sequence: Synthetic peptide
  N-terminus acetylated
LSWAADLQAVVTDWVASGLDKDYLKPDD

SEQ ID NO: 850 - protein, 28 aa, Artificial Sequence
  Description of Artificial Sequence: Synthetic peptide
LSTAADVQAVVTDWVASGLDKDYLKPDD

SEQ ID NO: 851 - protein, 28 aa, Artificial Sequence
  Description of Artificial Sequence: Synthetic peptide
  N-terminus acetylated
LSTAADVQAVVTDWVASGLDKDYLKPDD

SEQ ID NO: 852 - protein, 28 aa, Artificial Sequence
  Description of Artificial Sequence: Synthetic peptide
LSWAADVQAVVTDWVASGLDKDYLKPDD

SEQ ID NO: 853 - protein, 28 aa, Artificial Sequence
  Description of Artificial Sequence: Synthetic peptide
  N-terminus acetylated
LSWAADVQAVVTDWVASGLDKDYLKPDD

SEQ ID NO: 854 - protein, 28 aa, Artificial Sequence
  Description of Artificial Sequence: Synthetic peptide
LSTAADMWAVVTDWVASGLDKDYLKPDD

SEQ ID NO: 855 - protein, 28 aa, Artificial Sequence
  Description of Artificial Sequence: Synthetic peptide
  N-terminus acetylated
LSTAADMWAVVTDWVASGLDKDYLKPDD

SEQ ID NO: 856 - protein, 28 aa, Artificial Sequence
  Description of Artificial Sequence: Synthetic peptide
LSWAADMWAVVTDWVASGLDKDYLKPDD

SEQ ID NO: 857 - protein, 28 aa, Artificial Sequence
  Description of Artificial Sequence: Synthetic peptide
  N-terminus acetylated
LSWAADMWAVVTDWVASGLDKDYLKPDD

SEQ ID NO: 858 - protein, 28 aa, Artificial Sequence
  Description of Artificial Sequence: Synthetic peptide
LSTAADLWAVVTDWVASGLDKDYLKPDD

SEQ ID NO: 859 - protein, 28 aa, Artificial Sequence
  Description of Artificial Sequence: Synthetic peptide
  N-terminus acetylated
LSTAADLWAVVTDWVASGLDKDYLKPDD

SEQ ID NO: 860 - protein, 28 aa, Artificial Sequence
  Description of Artificial Sequence: Synthetic peptide
LSWAADLWAVVTDWVASGLDKDYLKPDD

SEQ ID NO: 861 - protein, 28 aa, Artificial Sequence
  Description of Artificial Sequence: Synthetic peptide
  N-terminus acetylated
LSWAADLWAVVTDWVASGLDKDYLKPDD

SEQ ID NO: 862 - protein, 28 aa, Artificial Sequence
  Description of Artificial Sequence: Synthetic peptide
LSTAADVWAVVTDWVASGLDKDYLKPDD

SEQ ID NO: 863 - protein, 28 aa, Artificial Sequence
  Description of Artificial Sequence: Synthetic peptide
  N-terminus acetylated
LSTAADVWAVVTDWVASGLDKDYLKPDD

SEQ ID NO: 864 - protein, 28 aa, Artificial Sequence
  Description of Artificial Sequence: Synthetic peptide
LSWAADVWAVVTDWVASGLDKDYLKPDD

SEQ ID NO: 865 - protein, 28 aa, Artificial Sequence
  Description of Artificial Sequence: Synthetic peptide
  N-terminus acetylated
LSWAADVWAVVTDWVASGLDKDYLKPDD

SEQ ID NO: 866 - protein, 28 aa, Artificial Sequence
  Description of Artificial Sequence: Synthetic peptide
LSTAADMQGVVWDWVASGLDKDYLKPDD

SEQ ID NO: 867 - protein, 28 aa, Artificial Sequence
  Description of Artificial Sequence: Synthetic peptide
  N-terminus acetylated
LSTAADMQGVVWDWVASGLDKDYLKPDD

SEQ ID NO: 868 - protein, 28 aa, Artificial Sequence
  Description of Artificial Sequence: Synthetic peptide
LSWAADMQGVVWDWVASGLDKDYLKPDD

SEQ ID NO: 869 - protein, 28 aa, Artificial Sequence
  Description of Artificial Sequence: Synthetic peptide
  N-terminus acetylated
LSWAADMQGVVWDWVASGLDKDYLKPDD

SEQ ID NO: 870 - protein, 28 aa, Artificial Sequence
  Description of Artificial Sequence: Synthetic peptide
LSTAADLQGVVWDWVASGLDKDYLKPDD

SEQ ID NO: 871 - protein, 28 aa, Artificial Sequence
  Description of Artificial Sequence: Synthetic peptide
  N-terminus acetylated
LSTAADLQGVVWDWVASGLDKDYLKPDD

SEQ ID NO: 872 - protein, 28 aa, Artificial Sequence
  Description of Artificial Sequence: Synthetic peptide
LSWAADLQGVVWDWVASGLDKDYLKPDD

SEQ ID NO: 873 - protein, 28 aa, Artificial Sequence
  Description of Artificial Sequence: Synthetic peptide
  N-terminus acetylated
LSWAADLQGVVWDWVASGLDKDYLKPDD

SEQ ID NO: 874 - protein, 28 aa, Artificial Sequence
  Description of Artificial Sequence: Synthetic peptide
LSTAADVQGVVWDWVASGLDKDYLKPDD

SEQ ID NO: 875 - protein, 28 aa, Artificial Sequence
  Description of Artificial Sequence: Synthetic peptide
  N-terminus acetylated
LSTAADVQGVVWDWVASGLDKDYLKPDD

SEQ ID NO: 876 - protein, 28 aa, Artificial Sequence
  Description of Artificial Sequence: Synthetic peptide
LSWAADVQGVVWDWVASGLDKDYLKPDD

SEQ ID NO: 877 - protein, 28 aa, Artificial Sequence
  Description of Artificial Sequence: Synthetic peptide
  N-terminus acetylated
LSWAADVQGVVWDWVASGLDKDYLKPDD

SEQ ID NO: 878 - protein, 28 aa, Artificial Sequence
  Description of Artificial Sequence: Synthetic peptide
LSTAADMWGVVWDWVASGLDKDYLKPDD

SEQ ID NO: 879 - protein, 28 aa, Artificial Sequence
  Description of Artificial Sequence: Synthetic peptide
  N-terminus acetylated
LSTAADMWGVVWDWVASGLDKDYLKPDD

SEQ ID NO: 880 - protein, 28 aa, Artificial Sequence
  Description of Artificial Sequence: Synthetic peptide
LSWAADMWGVVWDWVASGLDKDYLKPDD

SEQ ID NO: 881 - protein, 28 aa, Artificial Sequence
  Description of Artificial Sequence: Synthetic peptide
  N-terminus acetylated
LSWAADMWGVVWDWVASGLDKDYLKPDD

SEQ ID NO: 882 - protein, 28 aa, Artificial Sequence
  Description of Artificial Sequence: Synthetic peptide
LSTAADLWGVVWDWVASGLDKDYLKPDD

SEQ ID NO: 883 - protein, 28 aa, Artificial Sequence
  Description of Artificial Sequence: Synthetic peptide
  N-terminus acetylated
LSTAADLWGVVWDWVASGLDKDYLKPDD

SEQ ID NO: 884 - protein, 28 aa, Artificial Sequence
  Description of Artificial Sequence: Synthetic peptide
LSWAADLWGVVWDWVASGLDKDYLKPDD

SEQ ID NO: 885 - protein, 28 aa, Artificial Sequence
  Description of Artificial Sequence: Synthetic peptide
  N-terminus acetylated
LSWAADLWGVVWDWVASGLDKDYLKPDD

SEQ ID NO: 886 - protein, 28 aa, Artificial Sequence
  Description of Artificial Sequence: Synthetic peptide
LSTAADVWGVVWDWVASGLDKDYLKPDD

SEQ ID NO: 887 - protein, 28 aa, Artificial Sequence
  Description of Artificial Sequence: Synthetic peptide
  N-terminus acetylated
LSTAADVWGVVWDWVASGLDKDYLKPDD

SEQ ID NO: 888 - protein, 28 aa, Artificial Sequence
  Description of Artificial Sequence: Synthetic peptide
LSWAADVWGVVWDWVASGLDKDYLKPDD

SEQ ID NO: 889 - protein, 28 aa, Artificial Sequence
  Description of Artificial Sequence: Synthetic peptide
  N-terminus acetylated
LSWAADVWGVVWDWVASGLDKDYLKPDD

SEQ ID NO: 890 - protein, 28 aa, Artificial Sequence
  Description of Artificial Sequence: Synthetic peptide
LSTAADMQAVVWDWVASGLDKDYLKPDD

SEQ ID NO: 891 - protein, 28 aa, Artificial Sequence
  Description of Artificial Sequence: Synthetic peptide
  N-terminus acetylated
LSTAADMQAVVWDWVASGLDKDYLKPDD

SEQ ID NO: 892 - protein, 28 aa, Artificial Sequence
  Description of Artificial Sequence: Synthetic peptide
LSWAADMQAVVWDWVASGLDKDYLKPDD

SEQ ID NO: 893 - protein, 28 aa, Artificial Sequence
  Description of Artificial Sequence: Synthetic peptide
  N-terminus acetylated
LSWAADMQAVVWDWVASGLDKDYLKPDD

SEQ ID NO: 894 - protein, 28 aa, Artificial Sequence
  Description of Artificial Sequence: Synthetic peptide
LSTAADLQAVVWDWVASGLDKDYLKPDD

SEQ ID NO: 895 - protein, 28 aa, Artificial Sequence
  Description of Artificial Sequence: Synthetic peptide
  N-terminus acetylated
LSTAADLQAVVWDWVASGLDKDYLKPDD

SEQ ID NO: 896 - protein, 28 aa, Artificial Sequence
  Description of Artificial Sequence: Synthetic peptide
LSWAADLQAVVWDWVASGLDKDYLKPDD

SEQ ID NO: 897 - protein, 28 aa, Artificial Sequence
  Description of Artificial Sequence: Synthetic peptide
  N-terminus acetylated
LSWAADLQAVVWDWVASGLDKDYLKPDD

SEQ ID NO: 898 - protein, 28 aa, Artificial Sequence
  Description of Artificial Sequence: Synthetic peptide
LSTAADVQAVVWDWVASGLDKDYLKPDD

SEQ ID NO: 899 - protein, 28 aa, Artificial Sequence
  Description of Artificial Sequence: Synthetic peptide
  N-terminus acetylated
LSTAADVQAVVWDWVASGLDKDYLKPDD

SEQ ID NO: 900 - protein, 28 aa, Artificial Sequence
  Description of Artificial Sequence: Synthetic peptide
LSWAADVQAVVWDWVASGLDKDYLKPDD

SEQ ID NO: 901 - protein, 28 aa, Artificial Sequence
  Description of Artificial Sequence: Synthetic peptide
  N-terminus acetylated
LSWAADVQAVVWDWVASGLDKDYLKPDD

SEQ ID NO: 902 - protein, 28 aa, Artificial Sequence
  Description of Artificial Sequence: Synthetic peptide
LSTAADMWAVVWDWVASGLDKDYLKPDD

SEQ ID NO: 903 - protein, 28 aa, Artificial Sequence
  Description of Artificial Sequence: Synthetic peptide
  N-terminus acetylated
LSTAADMWAVVWDWVASGLDKDYLKPDD

SEQ ID NO: 904 - protein, 28 aa, Artificial Sequence
  Description of Artificial Sequence: Synthetic peptide
LSWAADMWAVVWDWVASGLDKDYLKPDD

SEQ ID NO: 905 - protein, 28 aa, Artificial Sequence
  Description of Artificial Sequence: Synthetic peptide
  N-terminus acetylated
LSWAADMWAVVWDWVASGLDKDYLKPDD

SEQ ID NO: 906 - protein, 28 aa, Artificial Sequence
  Description of Artificial Sequence: Synthetic peptide
LSTAADLWAVVWDWVASGLDKDYLKPDD

SEQ ID NO: 907 - protein, 28 aa, Artificial Sequence
  Description of Artificial Sequence: Synthetic peptide
  N-terminus acetylated
LSTAADLWAVVWDWVASGLDKDYLKPDD

SEQ ID NO: 908 - protein, 28 aa, Artificial Sequence
  Description of Artificial Sequence: Synthetic peptide
LSWAADLWAVVWDWVASGLDKDYLKPDD

SEQ ID NO: 909 - protein, 28 aa, Artificial Sequence
  Description of Artificial Sequence: Synthetic peptide
  N-terminus acetylated
LSWAADLWAVVWDWVASGLDKDYLKPDD

SEQ ID NO: 910 - protein, 28 aa, Artificial Sequence
  Description of Artificial Sequence: Synthetic peptide
LSTAADVWAVVWDWVASGLDKDYLKPDD

SEQ ID NO: 911 - protein, 28 aa, Artificial Sequence
  Description of Artificial Sequence: Synthetic peptide
  N-terminus acetylated
LSTAADVWAVVWDWVASGLDKDYLKPDD

SEQ ID NO: 912 - protein, 28 aa, Artificial Sequence
  Description of Artificial Sequence: Synthetic peptide
LSWAADVWAVVWDWVASGLDKDYLKPDD

SEQ ID NO: 913 - protein, 28 aa, Artificial Sequence
  Description of Artificial Sequence: Synthetic peptide
  N-terminus acetylated
LSWAADVWAVVWDWVASGLDKDYLKPDD

SEQ ID NO: 914 - protein, 28 aa, Artificial Sequence
  Description of Artificial Sequence: Synthetic peptide
  C-terminus amidated
LSTAADMQGVVTDGMASGLDKDYLKPDD

SEQ ID NO: 915 - protein, 28 aa, Artificial Sequence
  Description of Artificial Sequence: Synthetic peptide
  N-terminus acetylated
  C-terminus amidated
LSTAADMQGVVTDGMASGLDKDYLKPDD

SEQ ID NO: 916 - protein, 28 aa, Artificial Sequence
  Description of Artificial Sequence: Synthetic peptide
  C-terminus amidated
LSWAADMQGVVTDGMASGLDKDYLKPDD

SEQ ID NO: 917 - protein, 28 aa, Artificial Sequence
  Description of Artificial Sequence: Synthetic peptide
  N-terminus acetylated
  C-terminus amidated
LSWAADMQGVVTDGMASGLDKDYLKPDD

SEQ ID NO: 918 - protein, 28 aa, Artificial Sequence
  Description of Artificial Sequence: Synthetic peptide
  C-terminus amidated
LSTAADLQGVVTDGMASGLDKDYLKPDD

SEQ ID NO: 919 - protein, 28 aa, Artificial Sequence
  Description of Artificial Sequence: Synthetic peptide
  N-terminus acetylated
  C-terminus amidated
LSTAADLQGVVTDGMASGLDKDYLKPDD

SEQ ID NO: 920 - protein, 28 aa, Artificial Sequence
  Description of Artificial Sequence: Synthetic peptide
  C-terminus amidated
LSWAADLQGVVTDGMASGLDKDYLKPDD

SEQ ID NO: 921 - protein, 28 aa, Artificial Sequence
  Description of Artificial Sequence: Synthetic peptide
  N-terminus acetylated
  C-terminus amidated
LSWAADLQGVVTDGMASGLDKDYLKPDD

SEQ ID NO: 922 - protein, 28 aa, Artificial Sequence
  Description of Artificial Sequence: Synthetic peptide
  C-terminus amidated
LSTAADVQGVVTDGMASGLDKDYLKPDD

SEQ ID NO: 923 - protein, 28 aa, Artificial Sequence
  Description of Artificial Sequence: Synthetic peptide
  N-terminus acetylated
  C-terminus amidated
LSTAADVQGVVTDGMASGLDKDYLKPDD

SEQ ID NO: 924 - protein, 28 aa, Artificial Sequence
  Description of Artificial Sequence: Synthetic peptide
  C-terminus amidated
LSWAADVQGVVTDGMASGLDKDYLKPDD

SEQ ID NO: 925 - protein, 28 aa, Artificial Sequence
  Description of Artificial Sequence: Synthetic peptide
  N-terminus acetylated
  C-terminus amidated
LSWAADVQGVVTDGMASGLDKDYLKPDD

SEQ ID NO: 926 - protein, 28 aa, Artificial Sequence
  Description of Artificial Sequence: Synthetic peptide
  C-terminus amidated
LSTAADMWGVVTDGMASGLDKDYLKPDD

SEQ ID NO: 927 - protein, 28 aa, Artificial Sequence
  Description of Artificial Sequence: Synthetic peptide
  N-terminus acetylated
  C-terminus amidated
LSTAADMWGVVTDGMASGLDKDYLKPDD

SEQ ID NO: 928 - protein, 28 aa, Artificial Sequence
  Description of Artificial Sequence: Synthetic peptide
  C-terminus amidated
LSWAADMWGVVTDGMASGLDKDYLKPDD

SEQ ID NO: 929 - protein, 28 aa, Artificial Sequence
  Description of Artificial Sequence: Synthetic peptide
  N-terminus acetylated
  C-terminus amidated
LSWAADMWGVVTDGMASGLDKDYLKPDD

SEQ ID NO: 930 - protein, 28 aa, Artificial Sequence
  Description of Artificial Sequence: Synthetic peptide
  C-terminus amidated
LSTAADLWGVVTDGMASGLDKDYLKPDD

SEQ ID NO: 931 - protein, 28 aa, Artificial Sequence
  Description of Artificial Sequence: Synthetic peptide
  N-terminus acetylated
  C-terminus amidated
LSTAADLWGVVTDGMASGLDKDYLKPDD

SEQ ID NO: 932 - protein, 28 aa, Artificial Sequence
  Description of Artificial Sequence: Synthetic peptide
  C-terminus amidated
LSWAADLWGVVTDGMASGLDKDYLKPDD

SEQ ID NO: 933 - protein, 28 aa, Artificial Sequence
  Description of Artificial Sequence: Synthetic peptide
  N-terminus acetylated
  C-terminus amidated
LSWAADLWGVVTDGMASGLDKDYLKPDD

SEQ ID NO: 934 - protein, 28 aa, Artificial Sequence
  Description of Artificial Sequence: Synthetic peptide
  C-terminus amidated
LSTAADVWGVVTDGMASGLDKDYLKPDD

SEQ ID NO: 935 - protein, 28 aa, Artificial Sequence
  Description of Artificial Sequence: Synthetic peptide
  N-terminus acetylated
  C-terminus amidated
LSTAADVWGVVTDGMASGLDKDYLKPDD

SEQ ID NO: 936 - protein, 28 aa, Artificial Sequence
  Description of Artificial Sequence: Synthetic peptide
  C-terminus amidated
LSWAADVWGVVTDGMASGLDKDYLKPDD

SEQ ID NO: 937 - protein, 28 aa, Artificial Sequence
  Description of Artificial Sequence: Synthetic peptide
  N-terminus acetylated
  C-terminus amidated
LSWAADVWGVVTDGMASGLDKDYLKPDD

SEQ ID NO: 938 - protein, 28 aa, Artificial Sequence
  Description of Artificial Sequence: Synthetic peptide
  C-terminus amidated
LSTAADMQAVVTDGMASGLDKDYLKPDD

SEQ ID NO: 939 - protein, 28 aa, Artificial Sequence
  Description of Artificial Sequence: Synthetic peptide
  N-terminus acetylated
  C-terminus amidated
LSTAADMQAVVTDGMASGLDKDYLKPDD

SEQ ID NO: 940 - protein, 28 aa, Artificial Sequence
  Description of Artificial Sequence: Synthetic peptide
  C-terminus amidated
LSWAADMQAVVTDGMASGLDKDYLKPDD

SEQ ID NO: 941 - protein, 28 aa, Artificial Sequence
  Description of Artificial Sequence: Synthetic peptide
  N-terminus acetylated
  C-terminus amidated
LSWAADMQAVVTDGMASGLDKDYLKPDD

SEQ ID NO: 942 - protein, 28 aa, Artificial Sequence
  Description of Artificial Sequence: Synthetic peptide
  C-terminus amidated
LSTAADLQAVVTDGMASGLDKDYLKPDD

SEQ ID NO: 943 - protein, 28 aa, Artificial Sequence
  Description of Artificial Sequence: Synthetic peptide
  N-terminus acetylated
  C-terminus amidated
LSTAADLQAVVTDGMASGLDKDYLKPDD

SEQ ID NO: 944 - protein, 28 aa, Artificial Sequence
  Description of Artificial Sequence: Synthetic peptide
  C-terminus amidated
LSWAADLQAVVTDGMASGLDKDYLKPDD

SEQ ID NO: 945 - protein, 28 aa, Artificial Sequence
  Description of Artificial Sequence: Synthetic peptide
  N-terminus acetylated
  C-terminus amidated
LSWAADLQAVVTDGMASGLDKDYLKPDD

SEQ ID NO: 946 - protein, 28 aa, Artificial Sequence
  Description of Artificial Sequence: Synthetic peptide
  C-terminus amidated
LSTAADVQAVVTDGMASGLDKDYLKPDD

SEQ ID NO: 947 - protein, 28 aa, Artificial Sequence
  Description of Artificial Sequence: Synthetic peptide
  N-terminus acetylated
  C-terminus amidated
LSTAADVQAVVTDGMASGLDKDYLKPDD

SEQ ID NO: 948 - protein, 28 aa, Artificial Sequence
  Description of Artificial Sequence: Synthetic peptide
  C-terminus amidated
LSWAADVQAVVTDGMASGLDKDYLKPDD

SEQ ID NO: 949 - protein, 28 aa, Artificial Sequence
  Description of Artificial Sequence: Synthetic peptide
  N-terminus acetylated
  C-terminus amidated
LSWAADVQAVVTDGMASGLDKDYLKPDD

SEQ ID NO: 950 - protein, 28 aa, Artificial Sequence
  Description of Artificial Sequence: Synthetic peptide
  C-terminus amidated
LSTAADMWAVVTDGMASGLDKDYLKPDD

SEQ ID NO: 951 - protein, 28 aa, Artificial Sequence
  Description of Artificial Sequence: Synthetic peptide
  N-terminus acetylated
  C-terminus amidated
LSTAADMWAVVTDGMASGLDKDYLKPDD

SEQ ID NO: 952 - protein, 28 aa, Artificial Sequence
  Description of Artificial Sequence: Synthetic peptide
  C-terminus amidated
LSWAADMWAVVTDGMASGLDKDYLKPDD

SEQ ID NO: 953 - protein, 28 aa, Artificial Sequence
  Description of Artificial Sequence: Synthetic peptide
  N-terminus acetylated
  C-terminus amidated
LSWAADMWAVVTDGMASGLDKDYLKPDD

SEQ ID NO: 954 - protein, 28 aa, Artificial Sequence
  Description of Artificial Sequence: Synthetic peptide
  C-terminus amidated
LSTAADLWAVVTDGMASGLDKDYLKPDD

SEQ ID NO: 955 - protein, 28 aa, Artificial Sequence
  Description of Artificial Sequence: Synthetic peptide
  N-terminus acetylated
  C-terminus amidated
LSTAADLWAVVTDGMASGLDKDYLKPDD

SEQ ID NO: 956 - protein, 28 aa, Artificial Sequence
  Description of Artificial Sequence: Synthetic peptide
  C-terminus amidated
LSWAADLWAVVTDGMASGLDKDYLKPDD

SEQ ID NO: 957 - protein, 28 aa, Artificial Sequence
  Description of Artificial Sequence: Synthetic peptide
  N-terminus acetylated
  C-terminus amidated
LSWAADLWAVVTDGMASGLDKDYLKPDD

SEQ ID NO: 958 - protein, 28 aa, Artificial Sequence
  Description of Artificial Sequence: Synthetic peptide
  C-terminus amidated
LSTAADVWAVVTDGMASGLDKDYLKPDD

SEQ ID NO: 959 - protein, 28 aa, Artificial Sequence
  Description of Artificial Sequence: Synthetic peptide
  N-terminus acetylated
  C-terminus amidated
LSTAADVWAVVTDGMASGLDKDYLKPDD

SEQ ID NO: 960 - protein, 28 aa, Artificial Sequence
  Description of Artificial Sequence: Synthetic peptide
  C-terminus amidated
LSWAADVWAVVTDGMASGLDKDYLKPDD

SEQ ID NO: 961 - protein, 28 aa, Artificial Sequence
  Description of Artificial Sequence: Synthetic peptide
  N-terminus acetylated
  C-terminus amidated
LSWAADVWAVVTDGMASGLDKDYLKPDD

SEQ ID NO: 962 - protein, 28 aa, Artificial Sequence
  Description of Artificial Sequence: Synthetic peptide
  C-terminus amidated
LSTAADMQGVVWDGMASGLDKDYLKPDD

SEQ ID NO: 963 - protein, 28 aa, Artificial Sequence
  Description of Artificial Sequence: Synthetic peptide
  N-terminus acetylated
  C-terminus amidated
LSTAADMQGVVWDGMASGLDKDYLKPDD

SEQ ID NO: 964 - protein, 28 aa, Artificial Sequence
  Description of Artificial Sequence: Synthetic peptide
  C-terminus amidated
LSWAADMQGVVWDGMASGLDKDYLKPDD

SEQ ID NO: 965 - protein, 28 aa, Artificial Sequence
  Description of Artificial Sequence: Synthetic peptide
  N-terminus acetylated
  C-terminus amidated
LSWAADMQGVVWDGMASGLDKDYLKPDD

SEQ ID NO: 966 - protein, 28 aa, Artificial Sequence
  Description of Artificial Sequence: Synthetic peptide
  C-terminus amidated
LSTAADLQGVVWDGMASGLDKDYLKPDD

SEQ ID NO: 967 - protein, 28 aa, Artificial Sequence
  Description of Artificial Sequence: Synthetic peptide
  N-terminus acetylated
  C-terminus amidated
LSTAADLQGVVWDGMASGLDKDYLKPDD

SEQ ID NO: 968 - protein, 28 aa, Artificial Sequence
  Description of Artificial Sequence: Synthetic peptide
  C-terminus amidated
LSWAADLQGVVWDGMASGLDKDYLKPDD

SEQ ID NO: 969 - protein, 28 aa, Artificial Sequence
  Description of Artificial Sequence: Synthetic peptide
  N-terminus acetylated
  C-terminus amidated
LSWAADLQGVVWDGMASGLDKDYLKPDD

SEQ ID NO: 970 - protein, 28 aa, Artificial Sequence
  Description of Artificial Sequence: Synthetic peptide
  C-terminus amidated
LSTAADVQGVVWDGMASGLDKDYLKPDD

SEQ ID NO: 971 - protein, 28 aa, Artificial Sequence
  Description of Artificial Sequence: Synthetic peptide
  N-terminus acetylated
  C-terminus amidated
LSTAADVQGVVWDGMASGLDKDYLKPDD

SEQ ID NO: 972 - protein, 28 aa, Artificial Sequence
  Description of Artificial Sequence: Synthetic peptide
  C-terminus amidated
LSWAADVQGVVWDGMASGLDKDYLKPDD

SEQ ID NO: 973 - protein, 28 aa, Artificial Sequence
  Description of Artificial Sequence: Synthetic peptide
  N-terminus acetylated
  C-terminus amidated
LSWAADVQGVVWDGMASGLDKDYLKPDD

SEQ ID NO: 974 - protein, 28 aa, Artificial Sequence
  Description of Artificial Sequence: Synthetic peptide
  C-terminus amidated
LSTAADMWGVVWDGMASGLDKDYLKPDD

SEQ ID NO: 975 - protein, 28 aa, Artificial Sequence
  Description of Artificial Sequence: Synthetic peptide
  N-terminus acetylated
  C-terminus amidated
LSTAADMWGVVWDGMASGLDKDYLKPDD

SEQ ID NO: 976 - protein, 28 aa, Artificial Sequence
  Description of Artificial Sequence: Synthetic peptide
  C-terminus amidated
LSWAADMWGVVWDGMASGLDKDYLKPDD

SEQ ID NO: 977 - protein, 28 aa, Artificial Sequence
  Description of Artificial Sequence: Synthetic peptide
  N-terminus acetylated
  C-terminus amidated
LSWAADMWGVVWDGMASGLDKDYLKPDD

SEQ ID NO: 978 - protein, 28 aa, Artificial Sequence
  Description of Artificial Sequence: Synthetic peptide
  C-terminus amidated
LSTAADLWGVVWDGMASGLDKDYLKPDD

SEQ ID NO: 979 - protein, 28 aa, Artificial Sequence
  Description of Artificial Sequence: Synthetic peptide
  N-terminus acetylated
  C-terminus amidated
LSTAADLWGVVWDGMASGLDKDYLKPDD

SEQ ID NO: 980 - protein, 28 aa, Artificial Sequence
  Description of Artificial Sequence: Synthetic peptide
  C-terminus amidated
LSWAADLWGVVWDGMASGLDKDYLKPDD

SEQ ID NO: 981 - protein, 28 aa, Artificial Sequence
  Description of Artificial Sequence: Synthetic peptide
  N-terminus acetylated
  C-terminus amidated
LSWAADLWGVVWDGMASGLDKDYLKPDD

SEQ ID NO: 982 - protein, 28 aa, Artificial Sequence
  Description of Artificial Sequence: Synthetic peptide
  C-terminus amidated
LSTAADVWGVVWDGMASGLDKDYLKPDD

SEQ ID NO: 983 - protein, 28 aa, Artificial Sequence
  Description of Artificial Sequence: Synthetic peptide
  N-terminus acetylated
  C-terminus amidated
LSTAADVWGVVWDGMASGLDKDYLKPDD

SEQ ID NO: 984 - protein, 28 aa, Artificial Sequence
  Description of Artificial Sequence: Synthetic peptide
  C-terminus amidated
LSWAADVWGVVWDGMASGLDKDYLKPDD

SEQ ID NO: 985 - protein, 28 aa, Artificial Sequence
  Description of Artificial Sequence: Synthetic peptide
  N-terminus acetylated
  C-terminus amidated
LSWAADVWGVVWDGMASGLDKDYLKPDD

SEQ ID NO: 986 - protein, 28 aa, Artificial Sequence
  Description of Artificial Sequence: Synthetic peptide
  C-terminus amidated
LSTAADMQAVVWDGMASGLDKDYLKPDD

SEQ ID NO: 987 - protein, 28 aa, Artificial Sequence
  Description of Artificial Sequence: Synthetic peptide
  N-terminus acetylated
  C-terminus amidated
LSTAADMQAVVWDGMASGLDKDYLKPDD

SEQ ID NO: 988 - protein, 28 aa, Artificial Sequence
  Description of Artificial Sequence: Synthetic peptide
  C-terminus amidated
LSWAADMQAVVWDGMASGLDKDYLKPDD

SEQ ID NO: 989 - protein, 28 aa, Artificial Sequence
  Description of Artificial Sequence: Synthetic peptide
  N-terminus acetylated
  C-terminus amidated
LSWAADMQAVVWDGMASGLDKDYLKPDD

SEQ ID NO: 990 - protein, 28 aa, Artificial Sequence
  Description of Artificial Sequence: Synthetic peptide
  C-terminus amidated
LSTAADLQAVVWDGMASGLDKDYLKPDD

SEQ ID NO: 991 - protein, 28 aa, Artificial Sequence
  Description of Artificial Sequence: Synthetic peptide
  N-terminus acetylated
  C-terminus amidated
LSTAADLQAVVWDGMASGLDKDYLKPDD

SEQ ID NO: 992 - protein, 28 aa, Artificial Sequence
  Description of Artificial Sequence: Synthetic peptide
  C-terminus amidated
LSWAADLQAVVWDGMASGLDKDYLKPDD

SEQ ID NO: 993 - protein, 28 aa, Artificial Sequence
  Description of Artificial Sequence: Synthetic peptide
  N-terminus acetylated
  C-terminus amidated
LSWAADLQAVVWDGMASGLDKDYLKPDD

SEQ ID NO: 994 - protein, 28 aa, Artificial Sequence
  Description of Artificial Sequence: Synthetic peptide
  C-terminus amidated
LSTAADVQAVVWDGMASGLDKDYLKPDD

SEQ ID NO: 995 - protein, 28 aa, Artificial Sequence
  Description of Artificial Sequence: Synthetic peptide
  N-terminus acetylated
  C-terminus amidated
LSTAADVQAVVWDGMASGLDKDYLKPDD

SEQ ID NO: 996 - protein, 28 aa, Artificial Sequence
  Description of Artificial Sequence: Synthetic peptide
  C-terminus amidated
LSWAADVQAVVWDGMASGLDKDYLKPDD

SEQ ID NO: 997 - protein, 28 aa, Artificial Sequence
  Description of Artificial Sequence: Synthetic peptide
  N-terminus acetylated
  C-terminus amidated
LSWAADVQAVVWDGMASGLDKDYLKPDD

SEQ ID NO: 998 - protein, 28 aa, Artificial Sequence
  Description of Artificial Sequence: Synthetic peptide
  C-terminus amidated
LSTAADMWAVVWDGMASGLDKDYLKPDD

SEQ ID NO: 999 - protein, 28 aa, Artificial Sequence
  Description of Artificial Sequence: Synthetic peptide
  N-terminus acetylated
  C-terminus amidated
LSTAADMWAVVWDGMASGLDKDYLKPDD

SEQ ID NO: 1000 - protein, 28 aa, Artificial Sequence
  Description of Artificial Sequence: Synthetic peptide
  C-terminus amidated
LSWAADMWAVVWDGMASGLDKDYLKPDD

SEQ ID NO: 1001 - protein, 28 aa, Artificial Sequence
  Description of Artificial Sequence: Synthetic peptide
  N-terminus acetylated
  C-terminus amidated
LSWAADMWAVVWDGMASGLDKDYLKPDD

SEQ ID NO: 1002 - protein, 28 aa, Artificial Sequence
  Description of Artificial Sequence: Synthetic peptide
  C-terminus amidated
LSTAADLWAVVWDGMASGLDKDYLKPDD

SEQ ID NO: 1003 - protein, 28 aa, Artificial Sequence
  Description of Artificial Sequence: Synthetic peptide
  N-terminus acetylated
  C-terminus amidated
LSTAADLWAVVWDGMASGLDKDYLKPDD

SEQ ID NO: 1004 - protein, 28 aa, Artificial Sequence
  Description of Artificial Sequence: Synthetic peptide
  C-terminus amidated
LSWAADLWAVVWDGMASGLDKDYLKPDD

SEQ ID NO: 1005 - protein, 28 aa, Artificial Sequence
  Description of Artificial Sequence: Synthetic peptide
  N-terminus acetylated
  C-terminus amidated
LSWAADLWAVVWDGMASGLDKDYLKPDD

SEQ ID NO: 1006 - protein, 28 aa, Artificial Sequence
  Description of Artificial Sequence: Synthetic peptide
  C-terminus amidated
LSTAADVWAVVWDGMASGLDKDYLKPDD

SEQ ID NO: 1007 - protein, 28 aa, Artificial Sequence
  Description of Artificial Sequence: Synthetic peptide
  N-terminus acetylated
  C-terminus amidated
LSTAADVWAVVWDGMASGLDKDYLKPDD

SEQ ID NO: 1008 - protein, 28 aa, Artificial Sequence
  Description of Artificial Sequence: Synthetic peptide
  C-terminus amidated
LSWAADVWAVVWDGMASGLDKDYLKPDD

SEQ ID NO: 1009 - protein, 28 aa, Artificial Sequence
  Description of Artificial Sequence: Synthetic peptide
  N-terminus acetylated
  C-terminus amidated
LSWAADVWAVVWDGMASGLDKDYLKPDD

SEQ ID NO: 1010 - protein, 28 aa, Artificial Sequence
  Description of Artificial Sequence: Synthetic peptide
  C-terminus amidated
LSTAADMQGVVTDTMASGLDKDYLKPDD

SEQ ID NO: 1011 - protein, 28 aa, Artificial Sequence
  Description of Artificial Sequence: Synthetic peptide
  N-terminus acetylated
  C-terminus amidated
LSTAADMQGVVTDTMASGLDKDYLKPDD

SEQ ID NO: 1012 - protein, 28 aa, Artificial Sequence
  Description of Artificial Sequence: Synthetic peptide
  C-terminus amidated
LSWAADMQGVVTDTMASGLDKDYLKPDD

SEQ ID NO: 1013 - protein, 28 aa, Artificial Sequence
  Description of Artificial Sequence: Synthetic peptide
  N-terminus acetylated
  C-terminus amidated
LSWAADMQGVVTDTMASGLDKDYLKPDD

SEQ ID NO: 1014 - protein, 28 aa, Artificial Sequence
  Description of Artificial Sequence: Synthetic peptide
  C-terminus amidated
LSTAADLQGVVTDTMASGLDKDYLKPDD

SEQ ID NO: 1015 - protein, 28 aa, Artificial Sequence
  Description of Artificial Sequence: Synthetic peptide
  N-terminus acetylated
  C-terminus amidated
LSTAADLQGVVTDTMASGLDKDYLKPDD

SEQ ID NO: 1016 - protein, 28 aa, Artificial Sequence
  Description of Artificial Sequence: Synthetic peptide
  C-terminus amidated
LSWAADLQGVVTDTMASGLDKDYLKPDD

SEQ ID NO: 1017 - protein, 28 aa, Artificial Sequence
  Description of Artificial Sequence: Synthetic peptide
  N-terminus acetylated
  C-terminus amidated
LSWAADLQGVVTDTMASGLDKDYLKPDD

SEQ ID NO: 1018 - protein, 28 aa, Artificial Sequence
  Description of Artificial Sequence: Synthetic peptide
  C-terminus amidated
LSTAADVQGVVTDTMASGLDKDYLKPDD

SEQ ID NO: 1019 - protein, 28 aa, Artificial Sequence
  Description of Artificial Sequence: Synthetic peptide
  N-terminus acetylated
  C-terminus amidated
LSTAADVQGVVTDTMASGLDKDYLKPDD

SEQ ID NO: 1020 - protein, 28 aa, Artificial Sequence
  Description of Artificial Sequence: Synthetic peptide
  C-terminus amidated
LSWAADVQGVVTDTMASGLDKDYLKPDD

SEQ ID NO: 1021 - protein, 28 aa, Artificial Sequence
  Description of Artificial Sequence: Synthetic peptide
  N-terminus acetylated
  C-terminus amidated
LSWAADVQGVVTDTMASGLDKDYLKPDD

SEQ ID NO: 1022 - protein, 28 aa, Artificial Sequence
  Description of Artificial Sequence: Synthetic peptide
  C-terminus amidated
LSTAADMWGVVTDTMASGLDKDYLKPDD

SEQ ID NO: 1023 - protein, 28 aa, Artificial Sequence
  Description of Artificial Sequence: Synthetic peptide
  N-terminus acetylated
  C-terminus amidated
LSTAADMWGVVTDTMASGLDKDYLKPDD

SEQ ID NO: 1024 - protein, 28 aa, Artificial Sequence
  Description of Artificial Sequence: Synthetic peptide
  C-terminus amidated
LSWAADMWGVVTDTMASGLDKDYLKPDD

SEQ ID NO: 1025 - protein, 28 aa, Artificial Sequence
  Description of Artificial Sequence: Synthetic peptide
  N-terminus acetylated
  C-terminus amidated
LSWAADMWGVVTDTMASGLDKDYLKPDD

SEQ ID NO: 1026 - protein, 28 aa, Artificial Sequence
  Description of Artificial Sequence: Synthetic peptide
  C-terminus amidated
LSTAADLWGVVTDTMASGLDKDYLKPDD

SEQ ID NO: 1027 - protein, 28 aa, Artificial Sequence
  Description of Artificial Sequence: Synthetic peptide
  N-terminus acetylated
  C-terminus amidated
LSTAADLWGVVTDTMASGLDKDYLKPDD

SEQ ID NO: 1028 - protein, 28 aa, Artificial Sequence
  Description of Artificial Sequence: Synthetic peptide
  C-terminus amidated
LSWAADLWGVVTDTMASGLDKDYLKPDD

SEQ ID NO: 1029 - protein, 28 aa, Artificial Sequence
  Description of Artificial Sequence: Synthetic peptide
  N-terminus acetylated
  C-terminus amidated
LSWAADLWGVVTDTMASGLDKDYLKPDD

SEQ ID NO: 1030 - protein, 28 aa, Artificial Sequence
  Description of Artificial Sequence: Synthetic peptide
  C-terminus amidated
LSTAADVWGVVTDTMASGLDKDYLKPDD

SEQ ID NO: 1031 - protein, 28 aa, Artificial Sequence
  Description of Artificial Sequence: Synthetic peptide
  N-terminus acetylated
  C-terminus amidated
LSTAADVWGVVTDTMASGLDKDYLKPDD

SEQ ID NO: 1032 - protein, 28 aa, Artificial Sequence
  Description of Artificial Sequence: Synthetic peptide
  C-terminus amidated
LSWAADVWGVVTDTMASGLDKDYLKPDD

SEQ ID NO: 1033 - protein, 28 aa, Artificial Sequence
  Description of Artificial Sequence: Synthetic peptide
  N-terminus acetylated
  C-terminus amidated
LSWAADVWGVVTDTMASGLDKDYLKPDD

SEQ ID NO: 1034 - protein, 28 aa, Artificial Sequence
  Description of Artificial Sequence: Synthetic peptide
  C-terminus amidated
LSTAADMQAVVTDTMASGLDKDYLKPDD

SEQ ID NO: 1035 - protein, 28 aa, Artificial Sequence
  Description of Artificial Sequence: Synthetic peptide
  N-terminus acetylated
  C-terminus amidated
LSTAADMQAVVTDTMASGLDKDYLKPDD

SEQ ID NO: 1036 - protein, 28 aa, Artificial Sequence
  Description of Artificial Sequence: Synthetic peptide
  C-terminus amidated
LSWAADMQAVVTDTMASGLDKDYLKPDD

SEQ ID NO: 1037 - protein, 28 aa, Artificial Sequence
  Description of Artificial Sequence: Synthetic peptide
  N-terminus acetylated
  C-terminus amidated
LSWAADMQAVVTDTMASGLDKDYLKPDD

SEQ ID NO: 1038 - protein, 28 aa, Artificial Sequence
  Description of Artificial Sequence: Synthetic peptide
  C-terminus amidated
LSTAADLQAVVTDTMASGLDKDYLKPDD

SEQ ID NO: 1039 - protein, 28 aa, Artificial Sequence
  Description of Artificial Sequence: Synthetic peptide
  N-terminus acetylated
  C-terminus amidated
LSTAADLQAVVTDTMASGLDKDYLKPDD

SEQ ID NO: 1040 - protein, 28 aa, Artificial Sequence
  Description of Artificial Sequence: Synthetic peptide
  C-terminus amidated
LSWAADLQAVVTDTMASGLDKDYLKPDD

SEQ ID NO: 1041 - protein, 28 aa, Artificial Sequence
  Description of Artificial Sequence: Synthetic peptide
  N-terminus acetylated
  C-terminus amidated
LSWAADLQAVVTDTMASGLDKDYLKPDD

SEQ ID NO: 1042 - protein, 28 aa, Artificial Sequence
  Description of Artificial Sequence: Synthetic peptide
  C-terminus amidated
LSTAADVQAVVTDTMASGLDKDYLKPDD

SEQ ID NO: 1043 - protein, 28 aa, Artificial Sequence
  Description of Artificial Sequence: Synthetic peptide
  N-terminus acetylated
  C-terminus amidated
LSTAADVQAVVTDTMASGLDKDYLKPDD

SEQ ID NO: 1044 - protein, 28 aa, Artificial Sequence
  Description of Artificial Sequence: Synthetic peptide
  C-terminus amidated
LSWAADVQAVVTDTMASGLDKDYLKPDD

SEQ ID NO: 1045 - protein, 28 aa, Artificial Sequence
  Description of Artificial Sequence: Synthetic peptide
  N-terminus acetylated
  C-terminus amidated
LSWAADVQAVVTDTMASGLDKDYLKPDD

SEQ ID NO: 1046 - protein, 28 aa, Artificial Sequence
  Description of Artificial Sequence: Synthetic peptide
  C-terminus amidated
LSTAADMWAVVTDTMASGLDKDYLKPDD

SEQ ID NO: 1047 - protein, 28 aa, Artificial Sequence
  Description of Artificial Sequence: Synthetic peptide
  N-terminus acetylated
  C-terminus amidated
LSTAADMWAVVTDTMASGLDKDYLKPDD

SEQ ID NO: 1048 - protein, 28 aa, Artificial Sequence
  Description of Artificial Sequence: Synthetic peptide
  C-terminus amidated
LSWAADMWAVVTDTMASGLDKDYLKPDD

SEQ ID NO: 1049 - protein, 28 aa, Artificial Sequence
  Description of Artificial Sequence: Synthetic peptide
  N-terminus acetylated
  C-terminus amidated
LSWAADMWAVVTDTMASGLDKDYLKPDD

SEQ ID NO: 1050 - protein, 28 aa, Artificial Sequence
  Description of Artificial Sequence: Synthetic peptide
  C-terminus amidated
LSTAADLWAVVTDTMASGLDKDYLKPDD

SEQ ID NO: 1051 - protein, 28 aa, Artificial Sequence
  Description of Artificial Sequence: Synthetic peptide
  N-terminus acetylated
  C-terminus amidated
LSTAADLWAVVTDTMASGLDKDYLKPDD

SEQ ID NO: 1052 - protein, 28 aa, Artificial Sequence
  Description of Artificial Sequence: Synthetic peptide
  C-terminus amidated
LSWAADLWAVVTDTMASGLDKDYLKPDD

SEQ ID NO: 1053 - protein, 28 aa, Artificial Sequence
  Description of Artificial Sequence: Synthetic peptide
  N-terminus acetylated
  C-terminus amidated
LSWAADLWAVVTDTMASGLDKDYLKPDD

SEQ ID NO: 1054 - protein, 28 aa, Artificial Sequence
  Description of Artificial Sequence: Synthetic peptide
  C-terminus amidated
LSTAADVWAVVTDTMASGLDKDYLKPDD

SEQ ID NO: 1055 - protein, 28 aa, Artificial Sequence
  Description of Artificial Sequence: Synthetic peptide
  N-terminus acetylated
  C-terminus amidated
LSTAADVWAVVTDTMASGLDKDYLKPDD

SEQ ID NO: 1056 - protein, 28 aa, Artificial Sequence
  Description of Artificial Sequence: Synthetic peptide
  C-terminus amidated
LSWAADVWAVVTDTMASGLDKDYLKPDD

SEQ ID NO: 1057 - protein, 28 aa, Artificial Sequence
  Description of Artificial Sequence: Synthetic peptide
  N-terminus acetylated
  C-terminus amidated
LSWAADVWAVVTDTMASGLDKDYLKPDD

SEQ ID NO: 1058 - protein, 28 aa, Artificial Sequence
  Description of Artificial Sequence: Synthetic peptide
  C-terminus amidated
LSTAADMQGVVWDTMASGLDKDYLKPDD

SEQ ID NO: 1059 - protein, 28 aa, Artificial Sequence
  Description of Artificial Sequence: Synthetic peptide
  N-terminus acetylated
  C-terminus amidated
LSTAADMQGVVWDTMASGLDKDYLKPDD

SEQ ID NO: 1060 - protein, 28 aa, Artificial Sequence
  Description of Artificial Sequence: Synthetic peptide
  C-terminus amidated
LSWAADMQGVVWDTMASGLDKDYLKPDD

SEQ ID NO: 1061 - protein, 28 aa, Artificial Sequence
  Description of Artificial Sequence: Synthetic peptide
  N-terminus acetylated
  C-terminus amidated
LSWAADMQGVVWDTMASGLDKDYLKPDD

SEQ ID NO: 1062 - protein, 28 aa, Artificial Sequence
  Description of Artificial Sequence: Synthetic peptide
  C-terminus amidated
LSTAADLQGVVWDTMASGLDKDYLKPDD

SEQ ID NO: 1063 - protein, 28 aa, Artificial Sequence
  Description of Artificial Sequence: Synthetic peptide
  N-terminus acetylated
  C-terminus amidated
LSTAADLQGVVWDTMASGLDKDYLKPDD

SEQ ID NO: 1064 - protein, 28 aa, Artificial Sequence
  Description of Artificial Sequence: Synthetic peptide
  C-terminus amidated
LSWAADLQGVVWDTMASGLDKDYLKPDD

SEQ ID NO: 1065 - protein, 28 aa, Artificial Sequence
  Description of Artificial Sequence: Synthetic peptide
  N-terminus acetylated
  C-terminus amidated
LSWAADLQGVVWDTMASGLDKDYLKPDD

SEQ ID NO: 1066 - protein, 28 aa, Artificial Sequence
  Description of Artificial Sequence: Synthetic peptide
  C-terminus amidated
LSTAADVQGVVWDTMASGLDKDYLKPDD

SEQ ID NO: 1067 - protein, 28 aa, Artificial Sequence
  Description of Artificial Sequence: Synthetic peptide
  N-terminus acetylated
  C-terminus amidated
LSTAADVQGVVWDTMASGLDKDYLKPDD

SEQ ID NO: 1068 - protein, 28 aa, Artificial Sequence
  Description of Artificial Sequence: Synthetic peptide
  C-terminus amidated
LSWAADVQGVVWDTMASGLDKDYLKPDD

SEQ ID NO: 1069 - protein, 28 aa, Artificial Sequence
  Description of Artificial Sequence: Synthetic peptide
  N-terminus acetylated
  C-terminus amidated
LSWAADVQGVVWDTMASGLDKDYLKPDD

SEQ ID NO: 1070 - protein, 28 aa, Artificial Sequence
  Description of Artificial Sequence: Synthetic peptide
  C-terminus amidated
LSTAADMWGVVWDTMASGLDKDYLKPDD

SEQ ID NO: 1071 - protein, 28 aa, Artificial Sequence
  Description of Artificial Sequence: Synthetic peptide
  N-terminus acetylated
  C-terminus amidated
LSTAADMWGVVWDTMASGLDKDYLKPDD

SEQ ID NO: 1072 - protein, 28 aa, Artificial Sequence
  Description of Artificial Sequence: Synthetic peptide
  C-terminus amidated
LSWAADMWGVVWDTMASGLDKDYLKPDD

SEQ ID NO: 1073 - protein, 28 aa, Artificial Sequence
  Description of Artificial Sequence: Synthetic peptide
  N-terminus acetylated
  C-terminus amidated
LSWAADMWGVVWDTMASGLDKDYLKPDD

SEQ ID NO: 1074 - protein, 28 aa, Artificial Sequence
  Description of Artificial Sequence: Synthetic peptide
  C-terminus amidated
LSTAADLWGVVWDTMASGLDKDYLKPDD

SEQ ID NO: 1075 - protein, 28 aa, Artificial Sequence
  Description of Artificial Sequence: Synthetic peptide
  N-terminus acetylated
  C-terminus amidated
LSTAADLWGVVWDTMASGLDKDYLKPDD

SEQ ID NO: 1076 - protein, 28 aa, Artificial Sequence
  Description of Artificial Sequence: Synthetic peptide
  C-terminus amidated
LSWAADLWGVVWDTMASGLDKDYLKPDD

SEQ ID NO: 1077 - protein, 28 aa, Artificial Sequence
  Description of Artificial Sequence: Synthetic peptide
  N-terminus acetylated
  C-terminus amidated
LSWAADLWGVVWDTMASGLDKDYLKPDD

SEQ ID NO: 1078 - protein, 28 aa, Artificial Sequence
  Description of Artificial Sequence: Synthetic peptide
  C-terminus amidated
LSTAADVWGVVWDTMASGLDKDYLKPDD

SEQ ID NO: 1079 - protein, 28 aa, Artificial Sequence
  Description of Artificial Sequence: Synthetic peptide
  N-terminus acetylated
  C-terminus amidated
LSTAADVWGVVWDTMASGLDKDYLKPDD

SEQ ID NO: 1080 - protein, 28 aa, Artificial Sequence
  Description of Artificial Sequence: Synthetic peptide
  C-terminus amidated
LSWAADVWGVVWDTMASGLDKDYLKPDD

SEQ ID NO: 1081 - protein, 28 aa, Artificial Sequence
  Description of Artificial Sequence: Synthetic peptide
  N-terminus acetylated
  C-terminus amidated
LSWAADVWGVVWDTMASGLDKDYLKPDD

SEQ ID NO: 1082 - protein, 28 aa, Artificial Sequence
  Description of Artificial Sequence: Synthetic peptide
  C-terminus amidated
LSTAADMQAVVWDTMASGLDKDYLKPDD

SEQ ID NO: 1083 - protein, 28 aa, Artificial Sequence
  Description of Artificial Sequence: Synthetic peptide
  N-terminus acetylated
  C-terminus amidated
LSTAADMQAVVWDTMASGLDKDYLKPDD

SEQ ID NO: 1084 - protein, 28 aa, Artificial Sequence
  Description of Artificial Sequence: Synthetic peptide
  C-terminus amidated
LSWAADMQAVVWDTMASGLDKDYLKPDD

SEQ ID NO: 1085 - protein, 28 aa, Artificial Sequence
  Description of Artificial Sequence: Synthetic peptide
  N-terminus acetylated
  C-terminus amidated
LSWAADMQAVVWDTMASGLDKDYLKPDD

SEQ ID NO: 1086 - protein, 28 aa, Artificial Sequence
  Description of Artificial Sequence: Synthetic peptide
  C-terminus amidated
LSTAADLQAVVWDTMASGLDKDYLKPDD

SEQ ID NO: 1087 - protein, 28 aa, Artificial Sequence
  Description of Artificial Sequence: Synthetic peptide
  N-terminus acetylated
  C-terminus amidated
LSTAADLQAVVWDTMASGLDKDYLKPDD

SEQ ID NO: 1088 - protein, 28 aa, Artificial Sequence
  Description of Artificial Sequence: Synthetic peptide
  C-terminus amidated
LSWAADLQAVVWDTMASGLDKDYLKPDD

SEQ ID NO: 1089 - protein, 28 aa, Artificial Sequence
  Description of Artificial Sequence: Synthetic peptide
  N-terminus acetylated
  C-terminus amidated
LSWAADLQAVVWDTMASGLDKDYLKPDD

SEQ ID NO: 1090 - protein, 28 aa, Artificial Sequence
  Description of Artificial Sequence: Synthetic peptide
  C-terminus amidated
LSTAADVQAVVWDTMASGLDKDYLKPDD

SEQ ID NO: 1091 - protein, 28 aa, Artificial Sequence
  Description of Artificial Sequence: Synthetic peptide
  N-terminus acetylated
  C-terminus amidated
LSTAADVQAVVWDTMASGLDKDYLKPDD

SEQ ID NO: 1092 - protein, 28 aa, Artificial Sequence
  Description of Artificial Sequence: Synthetic peptide
  C-terminus amidated
LSWAADVQAVVWDTMASGLDKDYLKPDD

SEQ ID NO: 1093 - protein, 28 aa, Artificial Sequence
  Description of Artificial Sequence: Synthetic peptide
  N-terminus acetylated
  C-terminus amidated
LSWAADVQAVVWDTMASGLDKDYLKPDD

SEQ ID NO: 1094 - protein, 28 aa, Artificial Sequence
  Description of Artificial Sequence: Synthetic peptide
  C-terminus amidated
LSTAADMWAVVWDTMASGLDKDYLKPDD

SEQ ID NO: 1095 - protein, 28 aa, Artificial Sequence
  Description of Artificial Sequence: Synthetic peptide
  N-terminus acetylated
  C-terminus amidated
LSTAADMWAVVWDTMASGLDKDYLKPDD

SEQ ID NO: 1096 - protein, 28 aa, Artificial Sequence
  Description of Artificial Sequence: Synthetic peptide
  C-terminus amidated
LSWAADMWAVVWDTMASGLDKDYLKPDD

SEQ ID NO: 1097 - protein, 28 aa, Artificial Sequence
  Description of Artificial Sequence: Synthetic peptide
  N-terminus acetylated
  C-terminus amidated
LSWAADMWAVVWDTMASGLDKDYLKPDD

SEQ ID NO: 1098 - protein, 28 aa, Artificial Sequence
  Description of Artificial Sequence: Synthetic peptide
  C-terminus amidated
LSTAADLWAVVWDTMASGLDKDYLKPDD

SEQ ID NO: 1099 - protein, 28 aa, Artificial Sequence
  Description of Artificial Sequence: Synthetic peptide
  N-terminus acetylated
  C-terminus amidated
LSTAADLWAVVWDTMASGLDKDYLKPDD

SEQ ID NO: 1100 - protein, 28 aa, Artificial Sequence
  Description of Artificial Sequence: Synthetic peptide
  C-terminus amidated
LSWAADLWAVVWDTMASGLDKDYLKPDD

SEQ ID NO: 1101 - protein, 28 aa, Artificial Sequence
  Description of Artificial Sequence: Synthetic peptide
  N-terminus acetylated
  C-terminus amidated
LSWAADLWAVVWDTMASGLDKDYLKPDD

SEQ ID NO: 1102 - protein, 28 aa, Artificial Sequence
  Description of Artificial Sequence: Synthetic peptide
  C-terminus amidated
LSTAADVWAVVWDTMASGLDKDYLKPDD

SEQ ID NO: 1103 - protein, 28 aa, Artificial Sequence
  Description of Artificial Sequence: Synthetic peptide
  N-terminus acetylated
  C-terminus amidated
LSTAADVWAVVWDTMASGLDKDYLKPDD

SEQ ID NO: 1104 - protein, 28 aa, Artificial Sequence
  Description of Artificial Sequence: Synthetic peptide
  C-terminus amidated
LSWAADVWAVVWDTMASGLDKDYLKPDD

SEQ ID NO: 1105 - protein, 28 aa, Artificial Sequence
  Description of Artificial Sequence: Synthetic peptide
  N-terminus acetylated
  C-terminus amidated
LSWAADVWAVVWDTMASGLDKDYLKPDD

SEQ ID NO: 1106 - protein, 28 aa, Artificial Sequence
  Description of Artificial Sequence: Synthetic peptide
  C-terminus amidated
LSTAADMQGVVTDWMASGLDKDYLKPDD

SEQ ID NO: 1107 - protein, 28 aa, Artificial Sequence
  Description of Artificial Sequence: Synthetic peptide
  N-terminus acetylated
  C-terminus amidated
LSTAADMQGVVTDWMASGLDKDYLKPDD

SEQ ID NO: 1108 - protein, 28 aa, Artificial Sequence
  Description of Artificial Sequence: Synthetic peptide
  C-terminus amidated
LSWAADMQGVVTDWMASGLDKDYLKPDD

SEQ ID NO: 1109 - protein, 28 aa, Artificial Sequence
  Description of Artificial Sequence: Synthetic peptide
  N-terminus acetylated
  C-terminus amidated
LSWAADMQGVVTDWMASGLDKDYLKPDD

SEQ ID NO: 1110 - protein, 28 aa, Artificial Sequence
  Description of Artificial Sequence: Synthetic peptide
  C-terminus amidated
LSTAADLQGVVTDWMASGLDKDYLKPDD

SEQ ID NO: 1111 - protein, 28 aa, Artificial Sequence
  Description of Artificial Sequence: Synthetic peptide
  N-terminus acetylated
  C-terminus amidated
LSTAADLQGVVTDWMASGLDKDYLKPDD

SEQ ID NO: 1112 - protein, 28 aa, Artificial Sequence
  Description of Artificial Sequence: Synthetic peptide
  C-terminus amidated
LSWAADLQGVVTDWMASGLDKDYLKPDD

SEQ ID NO: 1113 - protein, 28 aa, Artificial Sequence
  Description of Artificial Sequence: Synthetic peptide
  N-terminus acetylated
  C-terminus amidated
LSWAADLQGVVTDWMASGLDKDYLKPDD

SEQ ID NO: 1114 - protein, 28 aa, Artificial Sequence
  Description of Artificial Sequence: Synthetic peptide
  C-terminus amidated
LSTAADVQGVVTDWMASGLDKDYLKPDD

SEQ ID NO: 1115 - protein, 28 aa, Artificial Sequence
  Description of Artificial Sequence: Synthetic peptide
  N-terminus acetylated
  C-terminus amidated
LSTAADVQGVVTDWMASGLDKDYLKPDD

SEQ ID NO: 1116 - protein, 28 aa, Artificial Sequence
  Description of Artificial Sequence: Synthetic peptide
  C-terminus amidated
LSWAADVQGVVTDWMASGLDKDYLKPDD

SEQ ID NO: 1117 - protein, 28 aa, Artificial Sequence
  Description of Artificial Sequence: Synthetic peptide
  N-terminus acetylated
  C-terminus amidated
LSWAADVQGVVTDWMASGLDKDYLKPDD

SEQ ID NO: 1118 - protein, 28 aa, Artificial Sequence
  Description of Artificial Sequence: Synthetic peptide
  C-terminus amidated
LSTAADMWGVVTDWMASGLDKDYLKPDD

SEQ ID NO: 1119 - protein, 28 aa, Artificial Sequence
  Description of Artificial Sequence: Synthetic peptide
  N-terminus acetylated
  C-terminus amidated
LSTAADMWGVVTDWMASGLDKDYLKPDD

SEQ ID NO: 1120 - protein, 28 aa, Artificial Sequence
  Description of Artificial Sequence: Synthetic peptide
  C-terminus amidated
LSWAADMWGVVTDWMASGLDKDYLKPDD

SEQ ID NO: 1121 - protein, 28 aa, Artificial Sequence
  Description of Artificial Sequence: Synthetic peptide
  N-terminus acetylated
  C-terminus amidated
LSWAADMWGVVTDWMASGLDKDYLKPDD

SEQ ID NO: 1122 - protein, 28 aa, Artificial Sequence
  Description of Artificial Sequence: Synthetic peptide
  C-terminus amidated
LSTAADLWGVVTDWMASGLDKDYLKPDD

SEQ ID NO: 1123 - protein, 28 aa, Artificial Sequence
  Description of Artificial Sequence: Synthetic peptide
  N-terminus acetylated
  C-terminus amidated
LSTAADLWGVVTDWMASGLDKDYLKPDD

SEQ ID NO: 1124 - protein, 28 aa, Artificial Sequence
  Description of Artificial Sequence: Synthetic peptide
  C-terminus amidated
LSWAADLWGVVTDWMASGLDKDYLKPDD

SEQ ID NO: 1125 - protein, 28 aa, Artificial Sequence
  Description of Artificial Sequence: Synthetic peptide
  N-terminus acetylated
  C-terminus amidated
LSWAADLWGVVTDWMASGLDKDYLKPDD

SEQ ID NO: 1126 - protein, 28 aa, Artificial Sequence
  Description of Artificial Sequence: Synthetic peptide
  C-terminus amidated
LSTAADVWGVVTDWMASGLDKDYLKPDD

SEQ ID NO: 1127 - protein, 28 aa, Artificial Sequence
  Description of Artificial Sequence: Synthetic peptide
  N-terminus acetylated
  C-terminus amidated
LSTAADVWGVVTDWMASGLDKDYLKPDD

SEQ ID NO: 1128 - protein, 28 aa, Artificial Sequence
  Description of Artificial Sequence: Synthetic peptide
  C-terminus amidated
LSWAADVWGVVTDWMASGLDKDYLKPDD

SEQ ID NO: 1129 - protein, 28 aa, Artificial Sequence
  Description of Artificial Sequence: Synthetic peptide
  N-terminus acetylated
  C-terminus amidated
LSWAADVWGVVTDWMASGLDKDYLKPDD

SEQ ID NO: 1130 - protein, 28 aa, Artificial Sequence
  Description of Artificial Sequence: Synthetic peptide
  C-terminus amidated
LSTAADMQAVVTDWMASGLDKDYLKPDD

SEQ ID NO: 1131 - protein, 28 aa, Artificial Sequence
  Description of Artificial Sequence: Synthetic peptide
  N-terminus acetylated
  C-terminus amidated
LSTAADMQAVVTDWMASGLDKDYLKPDD

SEQ ID NO: 1132 - protein, 28 aa, Artificial Sequence
  Description of Artificial Sequence: Synthetic peptide
  C-terminus amidated
LSWAADMQAVVTDWMASGLDKDYLKPDD

SEQ ID NO: 1133 - protein, 28 aa, Artificial Sequence
  Description of Artificial Sequence: Synthetic peptide
  N-terminus acetylated
  C-terminus amidated
LSWAADMQAVVTDWMASGLDKDYLKPDD

SEQ ID NO: 1134 - protein, 28 aa, Artificial Sequence
  Description of Artificial Sequence: Synthetic peptide
  C-terminus amidated
LSTAADLQAVVTDWMASGLDKDYLKPDD

SEQ ID NO: 1135 - protein, 28 aa, Artificial Sequence
  Description of Artificial Sequence: Synthetic peptide
  N-terminus acetylated
  C-terminus amidated
LSTAADLQAVVTDWMASGLDKDYLKPDD

SEQ ID NO: 1136 - protein, 28 aa, Artificial Sequence
  Description of Artificial Sequence: Synthetic peptide
  C-terminus amidated
LSWAADLQAVVTDWMASGLDKDYLKPDD

SEQ ID NO: 1137 - protein, 28 aa, Artificial Sequence
  Description of Artificial Sequence: Synthetic peptide
  N-terminus acetylated
  C-terminus amidated
LSWAADLQAVVTDWMASGLDKDYLKPDD

SEQ ID NO: 1138 - protein, 28 aa, Artificial Sequence
  Description of Artificial Sequence: Synthetic peptide
  C-terminus amidated
LSTAADVQAVVTDWMASGLDKDYLKPDD

SEQ ID NO: 1139 - protein, 28 aa, Artificial Sequence
  Description of Artificial Sequence: Synthetic peptide
  N-terminus acetylated
  C-terminus amidated
LSTAADVQAVVTDWMASGLDKDYLKPDD

SEQ ID NO: 1140 - protein, 28 aa, Artificial Sequence
  Description of Artificial Sequence: Synthetic peptide
  C-terminus amidated
LSWAADVQAVVTDWMASGLDKDYLKPDD

SEQ ID NO: 1141 - protein, 28 aa, Artificial Sequence
  Description of Artificial Sequence: Synthetic peptide
  N-terminus acetylated
  C-terminus amidated
LSWAADVQAVVTDWMASGLDKDYLKPDD

SEQ ID NO: 1142 - protein, 28 aa, Artificial Sequence
  Description of Artificial Sequence: Synthetic peptide
  C-terminus amidated
LSTAADMWAVVTDWMASGLDKDYLKPDD

SEQ ID NO: 1143 - protein, 28 aa, Artificial Sequence
  Description of Artificial Sequence: Synthetic peptide
  N-terminus acetylated
  C-terminus amidated
LSTAADMWAVVTDWMASGLDKDYLKPDD

SEQ ID NO: 1144 - protein, 28 aa, Artificial Sequence
  Description of Artificial Sequence: Synthetic peptide
  C-terminus amidated
LSWAADMWAVVTDWMASGLDKDYLKPDD

SEQ ID NO: 1145 - protein, 28 aa, Artificial Sequence
  Description of Artificial Sequence: Synthetic peptide
  N-terminus acetylated
  C-terminus amidated
LSWAADMWAVVTDWMASGLDKDYLKPDD

SEQ ID NO: 1146 - protein, 28 aa, Artificial Sequence
  Description of Artificial Sequence: Synthetic peptide
  C-terminus amidated
LSTAADLWAVVTDWMASGLDKDYLKPDD

SEQ ID NO: 1147 - protein, 28 aa, Artificial Sequence
  Description of Artificial Sequence: Synthetic peptide
  N-terminus acetylated
  C-terminus amidated
LSTAADLWAVVTDWMASGLDKDYLKPDD

SEQ ID NO: 1148 - protein, 28 aa, Artificial Sequence
  Description of Artificial Sequence: Synthetic peptide
  C-terminus amidated
LSWAADLWAVVTDWMASGLDKDYLKPDD

SEQ ID NO: 1149 - protein, 28 aa, Artificial Sequence
  Description of Artificial Sequence: Synthetic peptide
  N-terminus acetylated
  C-terminus amidated
LSWAADLWAVVTDWMASGLDKDYLKPDD

SEQ ID NO: 1150 - protein, 28 aa, Artificial Sequence
  Description of Artificial Sequence: Synthetic peptide
  C-terminus amidated
LSTAADVWAVVTDWMASGLDKDYLKPDD

SEQ ID NO: 1151 - protein, 28 aa, Artificial Sequence
  Description of Artificial Sequence: Synthetic peptide
  N-terminus acetylated
  C-terminus amidated
LSTAADVWAVVTDWMASGLDKDYLKPDD

SEQ ID NO: 1152 - protein, 28 aa, Artificial Sequence
  Description of Artificial Sequence: Synthetic peptide
  C-terminus amidated
LSWAADVWAVVTDWMASGLDKDYLKPDD

SEQ ID NO: 1153 - protein, 28 aa, Artificial Sequence
  Description of Artificial Sequence: Synthetic peptide
  N-terminus acetylated
  C-terminus amidated
LSWAADVWAVVTDWMASGLDKDYLKPDD

SEQ ID NO: 1154 - protein, 28 aa, Artificial Sequence
  Description of Artificial Sequence: Synthetic peptide
  C-terminus amidated
LSTAADMQGVVWDWMASGLDKDYLKPDD

SEQ ID NO: 1155 - protein, 28 aa, Artificial Sequence
  Description of Artificial Sequence: Synthetic peptide
  N-terminus acetylated
  C-terminus amidated
LSTAADMQGVVWDWMASGLDKDYLKPDD

SEQ ID NO: 1156 - protein, 28 aa, Artificial Sequence
  Description of Artificial Sequence: Synthetic peptide
  C-terminus amidated
LSWAADMQGVVWDWMASGLDKDYLKPDD

SEQ ID NO: 1157 - protein, 28 aa, Artificial Sequence
  Description of Artificial Sequence: Synthetic peptide
  N-terminus acetylated
  C-terminus amidated
LSWAADMQGVVWDWMASGLDKDYLKPDD

SEQ ID NO: 1158 - protein, 28 aa, Artificial Sequence
  Description of Artificial Sequence: Synthetic peptide
  C-terminus amidated
LSTAADLQGVVWDWMASGLDKDYLKPDD

SEQ ID NO: 1159 - protein, 28 aa, Artificial Sequence
  Description of Artificial Sequence: Synthetic peptide
  N-terminus acetylated
  C-terminus amidated
LSTAADLQGVVWDWMASGLDKDYLKPDD

SEQ ID NO: 1160 - protein, 28 aa, Artificial Sequence
  Description of Artificial Sequence: Synthetic peptide
  C-terminus amidated
LSWAADLQGVVWDWMASGLDKDYLKPDD

SEQ ID NO: 1161 - protein, 28 aa, Artificial Sequence
  Description of Artificial Sequence: Synthetic peptide
  N-terminus acetylated
  C-terminus amidated
LSWAADLQGVVWDWMASGLDKDYLKPDD

SEQ ID NO: 1162 - protein, 28 aa, Artificial Sequence
  Description of Artificial Sequence: Synthetic peptide
  C-terminus amidated
LSTAADVQGVVWDWMASGLDKDYLKPDD

SEQ ID NO: 1163 - protein, 28 aa, Artificial Sequence
  Description of Artificial Sequence: Synthetic peptide
  N-terminus acetylated
  C-terminus amidated
LSTAADVQGVVWDWMASGLDKDYLKPDD

SEQ ID NO: 1164 - protein, 28 aa, Artificial Sequence
  Description of Artificial Sequence: Synthetic peptide
  C-terminus amidated
LSWAADVQGVVWDWMASGLDKDYLKPDD

SEQ ID NO: 1165 - protein, 28 aa, Artificial Sequence
  Description of Artificial Sequence: Synthetic peptide
  N-terminus acetylated
  C-terminus amidated
LSWAADVQGVVWDWMASGLDKDYLKPDD

SEQ ID NO: 1166 - protein, 28 aa, Artificial Sequence
  Description of Artificial Sequence: Synthetic peptide
  C-terminus amidated
LSTAADMWGVVWDWMASGLDKDYLKPDD

SEQ ID NO: 1167 - protein, 28 aa, Artificial Sequence
  Description of Artificial Sequence: Synthetic peptide
  N-terminus acetylated
  C-terminus amidated
LSTAADMWGVVWDWMASGLDKDYLKPDD

SEQ ID NO: 1168 - protein, 28 aa, Artificial Sequence
  Description of Artificial Sequence: Synthetic peptide
  C-terminus amidated
LSWAADMWGVVWDWMASGLDKDYLKPDD

SEQ ID NO: 1169 - protein, 28 aa, Artificial Sequence
  Description of Artificial Sequence: Synthetic peptide
  N-terminus acetylated
  C-terminus amidated
LSWAADMWGVVWDWMASGLDKDYLKPDD

SEQ ID NO: 1170 - protein, 28 aa, Artificial Sequence
  Description of Artificial Sequence: Synthetic peptide
  C-terminus amidated
LSTAADLWGVVWDWMASGLDKDYLKPDD

SEQ ID NO: 1171 - protein, 28 aa, Artificial Sequence
  Description of Artificial Sequence: Synthetic peptide
  N-terminus acetylated
  C-terminus amidated
LSTAADLWGVVWDWMASGLDKDYLKPDD

SEQ ID NO: 1172 - protein, 28 aa, Artificial Sequence
  Description of Artificial Sequence: Synthetic peptide
  C-terminus amidated
LSWAADLWGVVWDWMASGLDKDYLKPDD

SEQ ID NO: 1173 - protein, 28 aa, Artificial Sequence
  Description of Artificial Sequence: Synthetic peptide
  N-terminus acetylated
  C-terminus amidated
LSWAADLWGVVWDWMASGLDKDYLKPDD

SEQ ID NO: 1174 - protein, 28 aa, Artificial Sequence
  Description of Artificial Sequence: Synthetic peptide
  C-terminus amidated
LSTAADVWGVVWDWMASGLDKDYLKPDD

SEQ ID NO: 1175 - protein, 28 aa, Artificial Sequence
  Description of Artificial Sequence: Synthetic peptide
  N-terminus acetylated
  C-terminus amidated
LSTAADVWGVVWDWMASGLDKDYLKPDD

SEQ ID NO: 1176 - protein, 28 aa, Artificial Sequence
  Description of Artificial Sequence: Synthetic peptide
  C-terminus amidated
LSWAADVWGVVWDWMASGLDKDYLKPDD

SEQ ID NO: 1177 - protein, 28 aa, Artificial Sequence
  Description of Artificial Sequence: Synthetic peptide
  N-terminus acetylated
  C-terminus amidated
LSWAADVWGVVWDWMASGLDKDYLKPDD

SEQ ID NO: 1178 - protein, 28 aa, Artificial Sequence
  Description of Artificial Sequence: Synthetic peptide
  C-terminus amidated
LSTAADMQAVVWDWMASGLDKDYLKPDD

SEQ ID NO: 1179 - protein, 28 aa, Artificial Sequence
  Description of Artificial Sequence: Synthetic peptide
  N-terminus acetylated
  C-terminus amidated
LSTAADMQAVVWDWMASGLDKDYLKPDD

SEQ ID NO: 1180 - protein, 28 aa, Artificial Sequence
  Description of Artificial Sequence: Synthetic peptide
  C-terminus amidated
LSWAADMQAVVWDWMASGLDKDYLKPDD

SEQ ID NO: 1181 - protein, 28 aa, Artificial Sequence
  Description of Artificial Sequence: Synthetic peptide
  N-terminus acetylated
  C-terminus amidated
LSWAADMQAVVWDWMASGLDKDYLKPDD

SEQ ID NO: 1182 - protein, 28 aa, Artificial Sequence
  Description of Artificial Sequence: Synthetic peptide
  C-terminus amidated
LSTAADLQAVVWDWMASGLDKDYLKPDD

SEQ ID NO: 1183 - protein, 28 aa, Artificial Sequence
  Description of Artificial Sequence: Synthetic peptide
  N-terminus acetylated
  C-terminus amidated
LSTAADLQAVVWDWMASGLDKDYLKPDD

SEQ ID NO: 1184 - protein, 28 aa, Artificial Sequence
  Description of Artificial Sequence: Synthetic peptide
  C-terminus amidated
LSWAADLQAVVWDWMASGLDKDYLKPDD

SEQ ID NO: 1185 - protein, 28 aa, Artificial Sequence
  Description of Artificial Sequence: Synthetic peptide
  N-terminus acetylated
  C-terminus amidated
LSWAADLQAVVWDWMASGLDKDYLKPDD

SEQ ID NO: 1186 - protein, 28 aa, Artificial Sequence
  Description of Artificial Sequence: Synthetic peptide
  C-terminus amidated
LSTAADVQAVVWDWMASGLDKDYLKPDD

SEQ ID NO: 1187 - protein, 28 aa, Artificial Sequence
  Description of Artificial Sequence: Synthetic peptide
  N-terminus acetylated
  C-terminus amidated
LSTAADVQAVVWDWMASGLDKDYLKPDD

SEQ ID NO: 1188 - protein, 28 aa, Artificial Sequence
  Description of Artificial Sequence: Synthetic peptide
  C-terminus amidated
LSWAADVQAVVWDWMASGLDKDYLKPDD

SEQ ID NO: 1189 - protein, 28 aa, Artificial Sequence
  Description of Artificial Sequence: Synthetic peptide
  N-terminus acetylated
  C-terminus amidated
LSWAADVQAVVWDWMASGLDKDYLKPDD

SEQ ID NO: 1190 - protein, 28 aa, Artificial Sequence
  Description of Artificial Sequence: Synthetic peptide
  C-terminus amidated
LSTAADMWAVVWDWMASGLDKDYLKPDD

SEQ ID NO: 1191 - protein, 28 aa, Artificial Sequence
  Description of Artificial Sequence: Synthetic peptide
  N-terminus acetylated
  C-terminus amidated
LSTAADMWAVVWDWMASGLDKDYLKPDD

SEQ ID NO: 1192 - protein, 28 aa, Artificial Sequence
  Description of Artificial Sequence: Synthetic peptide
  C-terminus amidated
LSWAADMWAVVWDWMASGLDKDYLKPDD

SEQ ID NO: 1193 - protein, 28 aa, Artificial Sequence
  Description of Artificial Sequence: Synthetic peptide
  N-terminus acetylated
  C-terminus amidated
LSWAADMWAVVWDWMASGLDKDYLKPDD

SEQ ID NO: 1194 - protein, 28 aa, Artificial Sequence
  Description of Artificial Sequence: Synthetic peptide
  C-terminus amidated
LSTAADLWAVVWDWMASGLDKDYLKPDD

SEQ ID NO: 1195 - protein, 28 aa, Artificial Sequence
  Description of Artificial Sequence: Synthetic peptide
  N-terminus acetylated
  C-terminus amidated
LSTAADLWAVVWDWMASGLDKDYLKPDD

SEQ ID NO: 1196 - protein, 28 aa, Artificial Sequence
  Description of Artificial Sequence: Synthetic peptide
  C-terminus amidated
LSWAADLWAVVWDWMASGLDKDYLKPDD

SEQ ID NO: 1197 - protein, 28 aa, Artificial Sequence
  Description of Artificial Sequence: Synthetic peptide
  N-terminus acetylated
  C-terminus amidated
LSWAADLWAVVWDWMASGLDKDYLKPDD

SEQ ID NO: 1198 - protein, 28 aa, Artificial Sequence
  Description of Artificial Sequence: Synthetic peptide
  C-terminus amidated
LSTAADVWAVVWDWMASGLDKDYLKPDD

SEQ ID NO: 1199 - protein, 28 aa, Artificial Sequence
  Description of Artificial Sequence: Synthetic peptide
  N-terminus acetylated
  C-terminus amidated
LSTAADVWAVVWDWMASGLDKDYLKPDD

SEQ ID NO: 1200 - protein, 28 aa, Artificial Sequence
  Description of Artificial Sequence: Synthetic peptide
  C-terminus amidated
LSWAADVWAVVWDWMASGLDKDYLKPDD

SEQ ID NO: 1201 - protein, 28 aa, Artificial Sequence
  Description of Artificial Sequence: Synthetic peptide
  N-terminus acetylated
  C-terminus amidated
LSWAADVWAVVWDWMASGLDKDYLKPDD

SEQ ID NO: 1202 - protein, 28 aa, Artificial Sequence
  Description of Artificial Sequence: Synthetic peptide
  C-terminus amidated
LSTAADMQGVVTDGLASGLDKDYLKPDD

SEQ ID NO: 1203 - protein, 28 aa, Artificial Sequence
  Description of Artificial Sequence: Synthetic peptide
  N-terminus acetylated
  C-terminus amidated
LSTAADMQGVVTDGLASGLDKDYLKPDD

SEQ ID NO: 1204 - protein, 28 aa, Artificial Sequence
  Description of Artificial Sequence: Synthetic peptide
  C-terminus amidated
LSWAADMQGVVTDGLASGLDKDYLKPDD

SEQ ID NO: 1205 - protein, 28 aa, Artificial Sequence
  Description of Artificial Sequence: Synthetic peptide
  N-terminus acetylated
  C-terminus amidated
LSWAADMQGVVTDGLASGLDKDYLKPDD

SEQ ID NO: 1206 - protein, 28 aa, Artificial Sequence
  Description of Artificial Sequence: Synthetic peptide
  C-terminus amidated
LSTAADLQGVVTDGLASGLDKDYLKPDD

SEQ ID NO: 1207 - protein, 28 aa, Artificial Sequence
  Description of Artificial Sequence: Synthetic peptide
  N-terminus acetylated
  C-terminus amidated
LSTAADLQGVVTDGLASGLDKDYLKPDD

SEQ ID NO: 1208 - protein, 28 aa, Artificial Sequence
  Description of Artificial Sequence: Synthetic peptide
  C-terminus amidated
LSWAADLQGVVTDGLASGLDKDYLKPDD

SEQ ID NO: 1209 - protein, 28 aa, Artificial Sequence
  Description of Artificial Sequence: Synthetic peptide
  N-terminus acetylated
  C-terminus amidated
LSWAADLQGVVTDGLASGLDKDYLKPDD

SEQ ID NO: 1210 - protein, 28 aa, Artificial Sequence
  Description of Artificial Sequence: Synthetic peptide
  C-terminus amidated
LSTAADVQGVVTDGLASGLDKDYLKPDD

SEQ ID NO: 1211 - protein, 28 aa, Artificial Sequence
  Description of Artificial Sequence: Synthetic peptide
  N-terminus acetylated
  C-terminus amidated
LSTAADVQGVVTDGLASGLDKDYLKPDD

SEQ ID NO: 1212 - protein, 28 aa, Artificial Sequence
  Description of Artificial Sequence: Synthetic peptide
  C-terminus amidated
LSWAADVQGVVTDGLASGLDKDYLKPDD

SEQ ID NO: 1213 - protein, 28 aa, Artificial Sequence
  Description of Artificial Sequence: Synthetic peptide
  N-terminus acetylated
  C-terminus amidated
LSWAADVQGVVTDGLASGLDKDYLKPDD

SEQ ID NO: 1214 - protein, 28 aa, Artificial Sequence
  Description of Artificial Sequence: Synthetic peptide
  C-terminus amidated
LSTAADMWGVVTDGLASGLDKDYLKPDD

SEQ ID NO: 1215 - protein, 28 aa, Artificial Sequence
  Description of Artificial Sequence: Synthetic peptide
  N-terminus acetylated
  C-terminus amidated
LSTAADMWGVVTDGLASGLDKDYLKPDD

SEQ ID NO: 1216 - protein, 28 aa, Artificial Sequence
  Description of Artificial Sequence: Synthetic peptide
  C-terminus amidated
LSWAADMWGVVTDGLASGLDKDYLKPDD

SEQ ID NO: 1217 - protein, 28 aa, Artificial Sequence
  Description of Artificial Sequence: Synthetic peptide
  N-terminus acetylated
  C-terminus amidated
LSWAADMWGVVTDGLASGLDKDYLKPDD

SEQ ID NO: 1218 - protein, 28 aa, Artificial Sequence
  Description of Artificial Sequence: Synthetic peptide
  C-terminus amidated
LSTAADLWGVVTDGLASGLDKDYLKPDD

SEQ ID NO: 1219 - protein, 28 aa, Artificial Sequence
  Description of Artificial Sequence: Synthetic peptide
  N-terminus acetylated
  C-terminus amidated
LSTAADLWGVVTDGLASGLDKDYLKPDD

SEQ ID NO: 1220 - protein, 28 aa, Artificial Sequence
  Description of Artificial Sequence: Synthetic peptide
  C-terminus amidated
LSWAADLWGVVTDGLASGLDKDYLKPDD

SEQ ID NO: 1221 - protein, 28 aa, Artificial Sequence
  Description of Artificial Sequence: Synthetic peptide
  N-terminus acetylated
  C-terminus amidated
LSWAADLWGVVTDGLASGLDKDYLKPDD

SEQ ID NO: 1222 - protein, 28 aa, Artificial Sequence
  Description of Artificial Sequence: Synthetic peptide
  C-terminus amidated
LSTAADVWGVVTDGLASGLDKDYLKPDD

SEQ ID NO: 1223 - protein, 28 aa, Artificial Sequence
  Description of Artificial Sequence: Synthetic peptide
  N-terminus acetylated
  C-terminus amidated
LSTAADVWGVVTDGLASGLDKDYLKPDD

SEQ ID NO: 1224 - protein, 28 aa, Artificial Sequence
  Description of Artificial Sequence: Synthetic peptide
  C-terminus amidated
LSWAADVWGVVTDGLASGLDKDYLKPDD

SEQ ID NO: 1225 - protein, 28 aa, Artificial Sequence
  Description of Artificial Sequence: Synthetic peptide
  N-terminus acetylated
  C-terminus amidated
LSWAADVWGVVTDGLASGLDKDYLKPDD

SEQ ID NO: 1226 - protein, 28 aa, Artificial Sequence
  Description of Artificial Sequence: Synthetic peptide
  C-terminus amidated
LSTAADMQAVVTDGLASGLDKDYLKPDD

SEQ ID NO: 1227 - protein, 28 aa, Artificial Sequence
  Description of Artificial Sequence: Synthetic peptide
  N-terminus acetylated
  C-terminus amidated
LSTAADMQAVVTDGLASGLDKDYLKPDD

SEQ ID NO: 1228 - protein, 28 aa, Artificial Sequence
  Description of Artificial Sequence: Synthetic peptide
  C-terminus amidated
LSWAADMQAVVTDGLASGLDKDYLKPDD

SEQ ID NO: 1229 - protein, 28 aa, Artificial Sequence
  Description of Artificial Sequence: Synthetic peptide
  N-terminus acetylated
  C-terminus amidated
LSWAADMQAVVTDGLASGLDKDYLKPDD

SEQ ID NO: 1230 - protein, 28 aa, Artificial Sequence
  Description of Artificial Sequence: Synthetic peptide
  C-terminus amidated
LSTAADLQAVVTDGLASGLDKDYLKPDD

SEQ ID NO: 1231 - protein, 28 aa, Artificial Sequence
  Description of Artificial Sequence: Synthetic peptide
  N-terminus acetylated
  C-terminus amidated
LSTAADLQAVVTDGLASGLDKDYLKPDD

SEQ ID NO: 1232 - protein, 28 aa, Artificial Sequence
  Description of Artificial Sequence: Synthetic peptide
  C-terminus amidated
LSWAADLQAVVTDGLASGLDKDYLKPDD

SEQ ID NO: 1233 - protein, 28 aa, Artificial Sequence
  Description of Artificial Sequence: Synthetic peptide
  N-terminus acetylated
  C-terminus amidated
LSWAADLQAVVTDGLASGLDKDYLKPDD

SEQ ID NO: 1234 - protein, 28 aa, Artificial Sequence
  Description of Artificial Sequence: Synthetic peptide
  C-terminus amidated
LSTAADVQAVVTDGLASGLDKDYLKPDD

SEQ ID NO: 1235 - protein, 28 aa, Artificial Sequence
  Description of Artificial Sequence: Synthetic peptide
  N-terminus acetylated
  C-terminus amidated
LSTAADVQAVVTDGLASGLDKDYLKPDD

SEQ ID NO: 1236 - protein, 28 aa, Artificial Sequence
  Description of Artificial Sequence: Synthetic peptide
  C-terminus amidated
LSWAADVQAVVTDGLASGLDKDYLKPDD

SEQ ID NO: 1237 - protein, 28 aa, Artificial Sequence
  Description of Artificial Sequence: Synthetic peptide
  N-terminus acetylated
  C-terminus amidated
LSWAADVQAVVTDGLASGLDKDYLKPDD

SEQ ID NO: 1238 - protein, 28 aa, Artificial Sequence
  Description of Artificial Sequence: Synthetic peptide
  C-terminus amidated
LSTAADMWAVVTDGLASGLDKDYLKPDD

SEQ ID NO: 1239 - protein, 28 aa, Artificial Sequence
  Description of Artificial Sequence: Synthetic peptide
  N-terminus acetylated
  C-terminus amidated
LSTAADMWAVVTDGLASGLDKDYLKPDD

SEQ ID NO: 1240 - protein, 28 aa, Artificial Sequence
  Description of Artificial Sequence: Synthetic peptide
  C-terminus amidated
LSWAADMWAVVTDGLASGLDKDYLKPDD

SEQ ID NO: 1241 - protein, 28 aa, Artificial Sequence
  Description of Artificial Sequence: Synthetic peptide
  N-terminus acetylated
  C-terminus amidated
LSWAADMWAVVTDGLASGLDKDYLKPDD

SEQ ID NO: 1242 - protein, 28 aa, Artificial Sequence
  Description of Artificial Sequence: Synthetic peptide
  C-terminus amidated
LSTAADLWAVVTDGLASGLDKDYLKPDD

SEQ ID NO: 1243 - protein, 28 aa, Artificial Sequence
  Description of Artificial Sequence: Synthetic peptide
  N-terminus acetylated
  C-terminus amidated
LSTAADLWAVVTDGLASGLDKDYLKPDD

SEQ ID NO: 1244 - protein, 28 aa, Artificial Sequence
  Description of Artificial Sequence: Synthetic peptide
  C-terminus amidated
LSWAADLWAVVTDGLASGLDKDYLKPDD

SEQ ID NO: 1245 - protein, 28 aa, Artificial Sequence
  Description of Artificial Sequence: Synthetic peptide
  N-terminus acetylated
  C-terminus amidated
LSWAADLWAVVTDGLASGLDKDYLKPDD

SEQ ID NO: 1246 - protein, 28 aa, Artificial Sequence
  Description of Artificial Sequence: Synthetic peptide
  C-terminus amidated
LSTAADVWAVVTDGLASGLDKDYLKPDD

SEQ ID NO: 1247 - protein, 28 aa, Artificial Sequence
  Description of Artificial Sequence: Synthetic peptide
  N-terminus acetylated
  C-terminus amidated
LSTAADVWAVVTDGLASGLDKDYLKPDD

SEQ ID NO: 1248 - protein, 28 aa, Artificial Sequence
  Description of Artificial Sequence: Synthetic peptide
  C-terminus amidated
LSWAADVWAVVTDGLASGLDKDYLKPDD

SEQ ID NO: 1249 - protein, 28 aa, Artificial Sequence
  Description of Artificial Sequence: Synthetic peptide
  N-terminus acetylated
  C-terminus amidated
LSWAADVWAVVTDGLASGLDKDYLKPDD

SEQ ID NO: 1250 - protein, 28 aa, Artificial Sequence
  Description of Artificial Sequence: Synthetic peptide
  C-terminus amidated
LSTAADMQGVVWDGLASGLDKDYLKPDD

SEQ ID NO: 1251 - protein, 28 aa, Artificial Sequence
  Description of Artificial Sequence: Synthetic peptide
  N-terminus acetylated
  C-terminus amidated
LSTAADMQGVVWDGLASGLDKDYLKPDD

SEQ ID NO: 1252 - protein, 28 aa, Artificial Sequence
  Description of Artificial Sequence: Synthetic peptide
  C-terminus amidated
LSWAADMQGVVWDGLASGLDKDYLKPDD

SEQ ID NO: 1253 - protein, 28 aa, Artificial Sequence
  Description of Artificial Sequence: Synthetic peptide
  N-terminus acetylated
  C-terminus amidated
LSWAADMQGVVWDGLASGLDKDYLKPDD

SEQ ID NO: 1254 - protein, 28 aa, Artificial Sequence
  Description of Artificial Sequence: Synthetic peptide
  C-terminus amidated
LSTAADLQGVVWDGLASGLDKDYLKPDD

SEQ ID NO: 1255 - protein, 28 aa, Artificial Sequence
  Description of Artificial Sequence: Synthetic peptide
  N-terminus acetylated
  C-terminus amidated
LSTAADLQGVVWDGLASGLDKDYLKPDD

SEQ ID NO: 1256 - protein, 28 aa, Artificial Sequence
  Description of Artificial Sequence: Synthetic peptide
  C-terminus amidated
LSWAADLQGVVWDGLASGLDKDYLKPDD

SEQ ID NO: 1257 - protein, 28 aa, Artificial Sequence
  Description of Artificial Sequence: Synthetic peptide
  N-terminus acetylated
  C-terminus amidated
LSWAADLQGVVWDGLASGLDKDYLKPDD

SEQ ID NO: 1258 - protein, 28 aa, Artificial Sequence
  Description of Artificial Sequence: Synthetic peptide
  C-terminus amidated
LSTAADVQGVVWDGLASGLDKDYLKPDD

SEQ ID NO: 1259 - protein, 28 aa, Artificial Sequence
  Description of Artificial Sequence: Synthetic peptide
  N-terminus acetylated
  C-terminus amidated
LSTAADVQGVVWDGLASGLDKDYLKPDD

SEQ ID NO: 1260 - protein, 28 aa, Artificial Sequence
  Description of Artificial Sequence: Synthetic peptide
  C-terminus amidated
LSWAADVQGVVWDGLASGLDKDYLKPDD

SEQ ID NO: 1261 - protein, 28 aa, Artificial Sequence
  Description of Artificial Sequence: Synthetic peptide
  N-terminus acetylated
  C-terminus amidated
LSWAADVQGVVWDGLASGLDKDYLKPDD

SEQ ID NO: 1262 - protein, 28 aa, Artificial Sequence
  Description of Artificial Sequence: Synthetic peptide
  C-terminus amidated
LSTAADMWGVVWDGLASGLDKDYLKPDD

SEQ ID NO: 1263 - protein, 28 aa, Artificial Sequence
  Description of Artificial Sequence: Synthetic peptide
  N-terminus acetylated
  C-terminus amidated
LSTAADMWGVVWDGLASGLDKDYLKPDD

SEQ ID NO: 1264 - protein, 28 aa, Artificial Sequence
  Description of Artificial Sequence: Synthetic peptide
  C-terminus amidated
LSWAADMWGVVWDGLASGLDKDYLKPDD

SEQ ID NO: 1265 - protein, 28 aa, Artificial Sequence
  Description of Artificial Sequence: Synthetic peptide
  N-terminus acetylated
  C-terminus amidated
LSWAADMWGVVWDGLASGLDKDYLKPDD

SEQ ID NO: 1266 - protein, 28 aa, Artificial Sequence
  Description of Artificial Sequence: Synthetic peptide
  C-terminus amidated
LSTAADLWGVVWDGLASGLDKDYLKPDD

SEQ ID NO: 1267 - protein, 28 aa, Artificial Sequence
  Description of Artificial Sequence: Synthetic peptide
  N-terminus acetylated
  C-terminus amidated
LSTAADLWGVVWDGLASGLDKDYLKPDD

SEQ ID NO: 1268 - protein, 28 aa, Artificial Sequence
  Description of Artificial Sequence: Synthetic peptide
  C-terminus amidated
LSWAADLWGVVWDGLASGLDKDYLKPDD

SEQ ID NO: 1269 - protein, 28 aa, Artificial Sequence
  Description of Artificial Sequence: Synthetic peptide
  N-terminus acetylated
  C-terminus amidated
LSWAADLWGVVWDGLASGLDKDYLKPDD

SEQ ID NO: 1270 - protein, 28 aa, Artificial Sequence
  Description of Artificial Sequence: Synthetic peptide
  C-terminus amidated
LSTAADVWGVVWDGLASGLDKDYLKPDD

SEQ ID NO: 1271 - protein, 28 aa, Artificial Sequence
  Description of Artificial Sequence: Synthetic peptide
  N-terminus acetylated
  C-terminus amidated
LSTAADVWGVVWDGLASGLDKDYLKPDD

SEQ ID NO: 1272 - protein, 28 aa, Artificial Sequence
  Description of Artificial Sequence: Synthetic peptide
  C-terminus amidated
LSWAADVWGVVWDGLASGLDKDYLKPDD

SEQ ID NO: 1273 - protein, 28 aa, Artificial Sequence
  Description of Artificial Sequence: Synthetic peptide
  N-terminus acetylated
  C-terminus amidated
LSWAADVWGVVWDGLASGLDKDYLKPDD

SEQ ID NO: 1274 - protein, 28 aa, Artificial Sequence
  Description of Artificial Sequence: Synthetic peptide
  C-terminus amidated
LSTAADMQAVVWDGLASGLDKDYLKPDD

SEQ ID NO: 1275 - protein, 28 aa, Artificial Sequence
  Description of Artificial Sequence: Synthetic peptide
  N-terminus acetylated
  C-terminus amidated
LSTAADMQAVVWDGLASGLDKDYLKPDD

SEQ ID NO: 1276 - protein, 28 aa, Artificial Sequence
  Description of Artificial Sequence: Synthetic peptide
  C-terminus amidated
LSWAADMQAVVWDGLASGLDKDYLKPDD

SEQ ID NO: 1277 - protein, 28 aa, Artificial Sequence
  Description of Artificial Sequence: Synthetic peptide
  N-terminus acetylated
  C-terminus amidated
LSWAADMQAVVWDGLASGLDKDYLKPDD

SEQ ID NO: 1278 - protein, 28 aa, Artificial Sequence
  Description of Artificial Sequence: Synthetic peptide
  C-terminus amidated
LSTAADLQAVVWDGLASGLDKDYLKPDD

SEQ ID NO: 1279 - protein, 28 aa, Artificial Sequence
  Description of Artificial Sequence: Synthetic peptide
  N-terminus acetylated
  C-terminus amidated
LSTAADLQAVVWDGLASGLDKDYLKPDD

SEQ ID NO: 1280 - protein, 28 aa, Artificial Sequence
  Description of Artificial Sequence: Synthetic peptide
  C-terminus amidated
LSWAADLQAVVWDGLASGLDKDYLKPDD

SEQ ID NO: 1281 - protein, 28 aa, Artificial Sequence
  Description of Artificial Sequence: Synthetic peptide
  N-terminus acetylated
  C-terminus amidated
LSWAADLQAVVWDGLASGLDKDYLKPDD

SEQ ID NO: 1282 - protein, 28 aa, Artificial Sequence
  Description of Artificial Sequence: Synthetic peptide
  C-terminus amidated
LSTAADVQAVVWDGLASGLDKDYLKPDD

SEQ ID NO: 1283 - protein, 28 aa, Artificial Sequence
  Description of Artificial Sequence: Synthetic peptide
  N-terminus acetylated
  C-terminus amidated
LSTAADVQAVVWDGLASGLDKDYLKPDD

SEQ ID NO: 1284 - protein, 28 aa, Artificial Sequence
  Description of Artificial Sequence: Synthetic peptide
  C-terminus amidated
LSWAADVQAVVWDGLASGLDKDYLKPDD

SEQ ID NO: 1285 - protein, 28 aa, Artificial Sequence
  Description of Artificial Sequence: Synthetic peptide
  N-terminus acetylated
  C-terminus amidated
LSWAADVQAVVWDGLASGLDKDYLKPDD

SEQ ID NO: 1286 - protein, 28 aa, Artificial Sequence
  Description of Artificial Sequence: Synthetic peptide
  C-terminus amidated
LSTAADMWAVVWDGLASGLDKDYLKPDD

SEQ ID NO: 1287 - protein, 28 aa, Artificial Sequence
  Description of Artificial Sequence: Synthetic peptide
  N-terminus acetylated
  C-terminus amidated
LSTAADMWAVVWDGLASGLDKDYLKPDD

SEQ ID NO: 1288 - protein, 28 aa, Artificial Sequence
  Description of Artificial Sequence: Synthetic peptide
  C-terminus amidated
LSWAADMWAVVWDGLASGLDKDYLKPDD

SEQ ID NO: 1289 - protein, 28 aa, Artificial Sequence
  Description of Artificial Sequence: Synthetic peptide
  N-terminus acetylated
  C-terminus amidated
LSWAADMWAVVWDGLASGLDKDYLKPDD

SEQ ID NO: 1290 - protein, 28 aa, Artificial Sequence
  Description of Artificial Sequence: Synthetic peptide
  C-terminus amidated
LSTAADLWAVVWDGLASGLDKDYLKPDD

SEQ ID NO: 1291 - protein, 28 aa, Artificial Sequence
  Description of Artificial Sequence: Synthetic peptide
  N-terminus acetylated
  C-terminus amidated
LSTAADLWAVVWDGLASGLDKDYLKPDD

SEQ ID NO: 1292 - protein, 28 aa, Artificial Sequence
  Description of Artificial Sequence: Synthetic peptide
  C-terminus amidated
LSWAADLWAVVWDGLASGLDKDYLKPDD

SEQ ID NO: 1293 - protein, 28 aa, Artificial Sequence
  Description of Artificial Sequence: Synthetic peptide
  N-terminus acetylated
  C-terminus amidated
LSWAADLWAVVWDGLASGLDKDYLKPDD

SEQ ID NO: 1294 - protein, 28 aa, Artificial Sequence
  Description of Artificial Sequence: Synthetic peptide
  C-terminus amidated
LSTAADVWAVVWDGLASGLDKDYLKPDD

SEQ ID NO: 1295 - protein, 28 aa, Artificial Sequence
  Description of Artificial Sequence: Synthetic peptide
  N-terminus acetylated
  C-terminus amidated
LSTAADVWAVVWDGLASGLDKDYLKPDD

SEQ ID NO: 1296 - protein, 28 aa, Artificial Sequence
  Description of Artificial Sequence: Synthetic peptide
  C-terminus amidated
LSWAADVWAVVWDGLASGLDKDYLKPDD

SEQ ID NO: 1297 - protein, 28 aa, Artificial Sequence
  Description of Artificial Sequence: Synthetic peptide
  N-terminus acetylated
  C-terminus amidated
LSWAADVWAVVWDGLASGLDKDYLKPDD

SEQ ID NO: 1298 - protein, 28 aa, Artificial Sequence
  Description of Artificial Sequence: Synthetic peptide
  C-terminus amidated
LSTAADMQGVVTDTLASGLDKDYLKPDD

SEQ ID NO: 1299 - protein, 28 aa, Artificial Sequence
  Description of Artificial Sequence: Synthetic peptide
  N-terminus acetylated
  C-terminus amidated
LSTAADMQGVVTDTLASGLDKDYLKPDD

SEQ ID NO: 1300 - protein, 28 aa, Artificial Sequence
  Description of Artificial Sequence: Synthetic peptide
  C-terminus amidated
LSWAADMQGVVTDTLASGLDKDYLKPDD

SEQ ID NO: 1301 - protein, 28 aa, Artificial Sequence
  Description of Artificial Sequence: Synthetic peptide
  N-terminus acetylated
  C-terminus amidated
LSWAADMQGVVTDTLASGLDKDYLKPDD

SEQ ID NO: 1302 - protein, 28 aa, Artificial Sequence
  Description of Artificial Sequence: Synthetic peptide
  C-terminus amidated
LSTAADLQGVVTDTLASGLDKDYLKPDD

SEQ ID NO: 1303 - protein, 28 aa, Artificial Sequence
  Description of Artificial Sequence: Synthetic peptide
  N-terminus acetylated
  C-terminus amidated
LSTAADLQGVVTDTLASGLDKDYLKPDD

SEQ ID NO: 1304 - protein, 28 aa, Artificial Sequence
  Description of Artificial Sequence: Synthetic peptide
  C-terminus amidated
LSWAADLQGVVTDTLASGLDKDYLKPDD

SEQ ID NO: 1305 - protein, 28 aa, Artificial Sequence
  Description of Artificial Sequence: Synthetic peptide
  N-terminus acetylated
  C-terminus amidated
LSWAADLQGVVTDTLASGLDKDYLKPDD

SEQ ID NO: 1306 - protein, 28 aa, Artificial Sequence
  Description of Artificial Sequence: Synthetic peptide
  C-terminus amidated
LSTAADVQGVVTDTLASGLDKDYLKPDD

SEQ ID NO: 1307 - protein, 28 aa, Artificial Sequence
  Description of Artificial Sequence: Synthetic peptide
  N-terminus acetylated
  C-terminus amidated
LSTAADVQGVVTDTLASGLDKDYLKPDD

SEQ ID NO: 1308 - protein, 28 aa, Artificial Sequence
  Description of Artificial Sequence: Synthetic peptide
  C-terminus amidated
LSWAADVQGVVTDTLASGLDKDYLKPDD

SEQ ID NO: 1309 - protein, 28 aa, Artificial Sequence
  Description of Artificial Sequence: Synthetic peptide
  N-terminus acetylated
  C-terminus amidated
LSWAADVQGVVTDTLASGLDKDYLKPDD

SEQ ID NO: 1310 - protein, 28 aa, Artificial Sequence
  Description of Artificial Sequence: Synthetic peptide
  C-terminus amidated
LSTAADMWGVVTDTLASGLDKDYLKPDD

SEQ ID NO: 1311 - protein, 28 aa, Artificial Sequence
  Description of Artificial Sequence: Synthetic peptide
  N-terminus acetylated
  C-terminus amidated
LSTAADMWGVVTDTLASGLDKDYLKPDD

SEQ ID NO: 1312 - protein, 28 aa, Artificial Sequence
  Description of Artificial Sequence: Synthetic peptide
  C-terminus amidated
LSWAADMWGVVTDTLASGLDKDYLKPDD

SEQ ID NO: 1313 - protein, 28 aa, Artificial Sequence
  Description of Artificial Sequence: Synthetic peptide
  N-terminus acetylated
  C-terminus amidated
LSWAADMWGVVTDTLASGLDKDYLKPDD

SEQ ID NO: 1314 - protein, 28 aa, Artificial Sequence
  Description of Artificial Sequence: Synthetic peptide
  C-terminus amidated
LSTAADLWGVVTDTLASGLDKDYLKPDD

SEQ ID NO: 1315 - protein, 28 aa, Artificial Sequence
  Description of Artificial Sequence: Synthetic peptide
  N-terminus acetylated
  C-terminus amidated
LSTAADLWGVVTDTLASGLDKDYLKPDD

SEQ ID NO: 1316 - protein, 28 aa, Artificial Sequence
  Description of Artificial Sequence: Synthetic peptide
  C-terminus amidated
LSWAADLWGVVTDTLASGLDKDYLKPDD

SEQ ID NO: 1317 - protein, 28 aa, Artificial Sequence
  Description of Artificial Sequence: Synthetic peptide
  N-terminus acetylated
  C-terminus amidated
LSWAADLWGVVTDTLASGLDKDYLKPDD

SEQ ID NO: 1318 - protein, 28 aa, Artificial Sequence
  Description of Artificial Sequence: Synthetic peptide
  C-terminus amidated
LSTAADVWGVVTDTLASGLDKDYLKPDD

SEQ ID NO: 1319 - protein, 28 aa, Artificial Sequence
  Description of Artificial Sequence: Synthetic peptide
  N-terminus acetylated
  C-terminus amidated
LSTAADVWGVVTDTLASGLDKDYLKPDD

SEQ ID NO: 1320 - protein, 28 aa, Artificial Sequence
  Description of Artificial Sequence: Synthetic peptide
  C-terminus amidated
LSWAADVWGVVTDTLASGLDKDYLKPDD

SEQ ID NO: 1321 - protein, 28 aa, Artificial Sequence
  Description of Artificial Sequence: Synthetic peptide
  N-terminus acetylated
  C-terminus amidated
LSWAADVWGVVTDTLASGLDKDYLKPDD

SEQ ID NO: 1322 - protein, 28 aa, Artificial Sequence
  Description of Artificial Sequence: Synthetic peptide
  C-terminus amidated
LSTAADMQAVVTDTLASGLDKDYLKPDD

SEQ ID NO: 1323 - protein, 28 aa, Artificial Sequence
  Description of Artificial Sequence: Synthetic peptide
  N-terminus acetylated
  C-terminus amidated
LSTAADMQAVVTDTLASGLDKDYLKPDD

SEQ ID NO: 1324 - protein, 28 aa, Artificial Sequence
  Description of Artificial Sequence: Synthetic peptide
  C-terminus amidated
LSWAADMQAVVTDTLASGLDKDYLKPDD

SEQ ID NO: 1325 - protein, 28 aa, Artificial Sequence
  Description of Artificial Sequence: Synthetic peptide
  N-terminus acetylated
  C-terminus amidated
LSWAADMQAVVTDTLASGLDKDYLKPDD

SEQ ID NO: 1326 - protein, 28 aa, Artificial Sequence
  Description of Artificial Sequence: Synthetic peptide
  C-terminus amidated
LSTAADLQAVVTDTLASGLDKDYLKPDD

SEQ ID NO: 1327 - protein, 28 aa, Artificial Sequence
  Description of Artificial Sequence: Synthetic peptide
  N-terminus acetylated
  C-terminus amidated
LSTAADLQAVVTDTLASGLDKDYLKPDD

SEQ ID NO: 1328 - protein, 28 aa, Artificial Sequence
  Description of Artificial Sequence: Synthetic peptide
  C-terminus amidated
LSWAADLQAVVTDTLASGLDKDYLKPDD

SEQ ID NO: 1329 - protein, 28 aa, Artificial Sequence
  Description of Artificial Sequence: Synthetic peptide
  N-terminus acetylated
  C-terminus amidated
LSWAADLQAVVTDTLASGLDKDYLKPDD

SEQ ID NO: 1330 - protein, 28 aa, Artificial Sequence
  Description of Artificial Sequence: Synthetic peptide
  C-terminus amidated
LSTAADVQAVVTDTLASGLDKDYLKPDD

SEQ ID NO: 1331 - protein, 28 aa, Artificial Sequence
  Description of Artificial Sequence: Synthetic peptide
  N-terminus acetylated
  C-terminus amidated
LSTAADVQAVVTDTLASGLDKDYLKPDD

SEQ ID NO: 1332 - protein, 28 aa, Artificial Sequence
  Description of Artificial Sequence: Synthetic peptide
  C-terminus amidated
LSWAADVQAVVTDTLASGLDKDYLKPDD

SEQ ID NO: 1333 - protein, 28 aa, Artificial Sequence
  Description of Artificial Sequence: Synthetic peptide
  N-terminus acetylated
  C-terminus amidated
LSWAADVQAVVTDTLASGLDKDYLKPDD

SEQ ID NO: 1334 - protein, 28 aa, Artificial Sequence
  Description of Artificial Sequence: Synthetic peptide
  C-terminus amidated
LSTAADMWAVVTDTLASGLDKDYLKPDD

SEQ ID NO: 1335 - protein, 28 aa, Artificial Sequence
  Description of Artificial Sequence: Synthetic peptide
  N-terminus acetylated
  C-terminus amidated
LSTAADMWAVVTDTLASGLDKDYLKPDD

SEQ ID NO: 1336 - protein, 28 aa, Artificial Sequence
  Description of Artificial Sequence: Synthetic peptide
  C-terminus amidated
LSWAADMWAVVTDTLASGLDKDYLKPDD

SEQ ID NO: 1337 - protein, 28 aa, Artificial Sequence
  Description of Artificial Sequence: Synthetic peptide
  N-terminus acetylated
  C-terminus amidated
LSWAADMWAVVTDTLASGLDKDYLKPDD

SEQ ID NO: 1338 - protein, 28 aa, Artificial Sequence
  Description of Artificial Sequence: Synthetic peptide
  C-terminus amidated
LSTAADLWAVVTDTLASGLDKDYLKPDD

SEQ ID NO: 1339 - protein, 28 aa, Artificial Sequence
  Description of Artificial Sequence: Synthetic peptide
  N-terminus acetylated
  C-terminus amidated
LSTAADLWAVVTDTLASGLDKDYLKPDD

SEQ ID NO: 1340 - protein, 28 aa, Artificial Sequence
  Description of Artificial Sequence: Synthetic peptide
  C-terminus amidated
LSWAADLWAVVTDTLASGLDKDYLKPDD

SEQ ID NO: 1341 - protein, 28 aa, Artificial Sequence
  Description of Artificial Sequence: Synthetic peptide
  N-terminus acetylated
  C-terminus amidated
LSWAADLWAVVTDTLASGLDKDYLKPDD

SEQ ID NO: 1342 - protein, 28 aa, Artificial Sequence
  Description of Artificial Sequence: Synthetic peptide
  C-terminus amidated
LSTAADVWAVVTDTLASGLDKDYLKPDD

SEQ ID NO: 1343 - protein, 28 aa, Artificial Sequence
  Description of Artificial Sequence: Synthetic peptide
  N-terminus acetylated
  C-terminus amidated
LSTAADVWAVVTDTLASGLDKDYLKPDD

SEQ ID NO: 1344 - protein, 28 aa, Artificial Sequence
  Description of Artificial Sequence: Synthetic peptide
  C-terminus amidated
LSWAADVWAVVTDTLASGLDKDYLKPDD

SEQ ID NO: 1345 - protein, 28 aa, Artificial Sequence
  Description of Artificial Sequence: Synthetic peptide
  N-terminus acetylated
  C-terminus amidated
LSWAADVWAVVTDTLASGLDKDYLKPDD

SEQ ID NO: 1346 - protein, 28 aa, Artificial Sequence
  Description of Artificial Sequence: Synthetic peptide
  C-terminus amidated
LSTAADMQGVVWDTLASGLDKDYLKPDD

SEQ ID NO: 1347 - protein, 28 aa, Artificial Sequence
  Description of Artificial Sequence: Synthetic peptide
  N-terminus acetylated
  C-terminus amidated
LSTAADMQGVVWDTLASGLDKDYLKPDD

SEQ ID NO: 1348 - protein, 28 aa, Artificial Sequence
  Description of Artificial Sequence: Synthetic peptide
  C-terminus amidated
LSWAADMQGVVWDTLASGLDKDYLKPDD

SEQ ID NO: 1349 - protein, 28 aa, Artificial Sequence
  Description of Artificial Sequence: Synthetic peptide
  N-terminus acetylated
  C-terminus amidated
LSWAADMQGVVWDTLASGLDKDYLKPDD

SEQ ID NO: 1350 - protein, 28 aa, Artificial Sequence
  Description of Artificial Sequence: Synthetic peptide
  C-terminus amidated
LSTAADLQGVVWDTLASGLDKDYLKPDD

SEQ ID NO: 1351 - protein, 28 aa, Artificial Sequence
  Description of Artificial Sequence: Synthetic peptide
  N-terminus acetylated
  C-terminus amidated
LSTAADLQGVVWDTLASGLDKDYLKPDD

SEQ ID NO: 1352 - protein, 28 aa, Artificial Sequence
  Description of Artificial Sequence: Synthetic peptide
  C-terminus amidated
LSWAADLQGVVWDTLASGLDKDYLKPDD

SEQ ID NO: 1353 - protein, 28 aa, Artificial Sequence
  Description of Artificial Sequence: Synthetic peptide
  N-terminus acetylated
  C-terminus amidated
LSWAADLQGVVWDTLASGLDKDYLKPDD

SEQ ID NO: 1354 - protein, 28 aa, Artificial Sequence
  Description of Artificial Sequence: Synthetic peptide
  C-terminus amidated
LSTAADVQGVVWDTLASGLDKDYLKPDD

SEQ ID NO: 1355 - protein, 28 aa, Artificial Sequence
  Description of Artificial Sequence: Synthetic peptide
  N-terminus acetylated
  C-terminus amidated
LSTAADVQGVVWDTLASGLDKDYLKPDD

SEQ ID NO: 1356 - protein, 28 aa, Artificial Sequence
  Description of Artificial Sequence: Synthetic peptide
  C-terminus amidated
LSWAADVQGVVWDTLASGLDKDYLKPDD

SEQ ID NO: 1357 - protein, 28 aa, Artificial Sequence
  Description of Artificial Sequence: Synthetic peptide
  N-terminus acetylated
  C-terminus amidated
LSWAADVQGVVWDTLASGLDKDYLKPDD

SEQ ID NO: 1358 - protein, 28 aa, Artificial Sequence
  Description of Artificial Sequence: Synthetic peptide
  C-terminus amidated
LSTAADMWGVVWDTLASGLDKDYLKPDD

SEQ ID NO: 1359 - protein, 28 aa, Artificial Sequence
  Description of Artificial Sequence: Synthetic peptide
  N-terminus acetylated
  C-terminus amidated
LSTAADMWGVVWDTLASGLDKDYLKPDD

SEQ ID NO: 1360 - protein, 28 aa, Artificial Sequence
  Description of Artificial Sequence: Synthetic peptide
  C-terminus amidated
LSWAADMWGVVWDTLASGLDKDYLKPDD

SEQ ID NO: 1361 - protein, 28 aa, Artificial Sequence
  Description of Artificial Sequence: Synthetic peptide
  N-terminus acetylated
  C-terminus amidated
LSWAADMWGVVWDTLASGLDKDYLKPDD

SEQ ID NO: 1362 - protein, 28 aa, Artificial Sequence
  Description of Artificial Sequence: Synthetic peptide
  C-terminus amidated
LSTAADLWGVVWDTLASGLDKDYLKPDD

SEQ ID NO: 1363 - protein, 28 aa, Artificial Sequence
  Description of Artificial Sequence: Synthetic peptide
  N-terminus acetylated
  C-terminus amidated
LSTAADLWGVVWDTLASGLDKDYLKPDD

SEQ ID NO: 1364 - protein, 28 aa, Artificial Sequence
  Description of Artificial Sequence: Synthetic peptide
  C-terminus amidated
LSWAADLWGVVWDTLASGLDKDYLKPDD

SEQ ID NO: 1365 - protein, 28 aa, Artificial Sequence
  Description of Artificial Sequence: Synthetic peptide
  N-terminus acetylated
  C-terminus amidated
LSWAADLWGVVWDTLASGLDKDYLKPDD

SEQ ID NO: 1366 - protein, 28 aa, Artificial Sequence
  Description of Artificial Sequence: Synthetic peptide
  C-terminus amidated
LSTAADVWGVVWDTLASGLDKDYLKPDD

SEQ ID NO: 1367 - protein, 28 aa, Artificial Sequence
  Description of Artificial Sequence: Synthetic peptide
  N-terminus acetylated
  C-terminus amidated
LSTAADVWGVVWDTLASGLDKDYLKPDD

SEQ ID NO: 1368 - protein, 28 aa, Artificial Sequence
  Description of Artificial Sequence: Synthetic peptide
  C-terminus amidated
LSWAADVWGVVWDTLASGLDKDYLKPDD

SEQ ID NO: 1369 - protein, 28 aa, Artificial Sequence
  Description of Artificial Sequence: Synthetic peptide
  N-terminus acetylated
  C-terminus amidated
LSWAADVWGVVWDTLASGLDKDYLKPDD

SEQ ID NO: 1370 - protein, 28 aa, Artificial Sequence
  Description of Artificial Sequence: Synthetic peptide
  C-terminus amidated
LSTAADMQAVVWDTLASGLDKDYLKPDD

SEQ ID NO: 1371 - protein, 28 aa, Artificial Sequence
  Description of Artificial Sequence: Synthetic peptide
  N-terminus acetylated
  C-terminus amidated
LSTAADMQAVVWDTLASGLDKDYLKPDD

SEQ ID NO: 1372 - protein, 28 aa, Artificial Sequence
  Description of Artificial Sequence: Synthetic peptide
  C-terminus amidated
LSWAADMQAVVWDTLASGLDKDYLKPDD

SEQ ID NO: 1373 - protein, 28 aa, Artificial Sequence
  Description of Artificial Sequence: Synthetic peptide
  N-terminus acetylated
  C-terminus amidated
LSWAADMQAVVWDTLASGLDKDYLKPDD

SEQ ID NO: 1374 - protein, 28 aa, Artificial Sequence
  Description of Artificial Sequence: Synthetic peptide
  C-terminus amidated
LSTAADLQAVVWDTLASGLDKDYLKPDD

SEQ ID NO: 1375 - protein, 28 aa, Artificial Sequence
  Description of Artificial Sequence: Synthetic peptide
  N-terminus acetylated
  C-terminus amidated
LSTAADLQAVVWDTLASGLDKDYLKPDD

SEQ ID NO: 1376 - protein, 28 aa, Artificial Sequence
  Description of Artificial Sequence: Synthetic peptide
  C-terminus amidated
LSWAADLQAVVWDTLASGLDKDYLKPDD

SEQ ID NO: 1377 - protein, 28 aa, Artificial Sequence
  Description of Artificial Sequence: Synthetic peptide
  N-terminus acetylated
  C-terminus amidated
LSWAADLQAVVWDTLASGLDKDYLKPDD

SEQ ID NO: 1378 - protein, 28 aa, Artificial Sequence
  Description of Artificial Sequence: Synthetic peptide
  C-terminus amidated
LSTAADVQAVVWDTLASGLDKDYLKPDD

SEQ ID NO: 1379 - protein, 28 aa, Artificial Sequence
  Description of Artificial Sequence: Synthetic peptide
  N-terminus acetylated
  C-terminus amidated
LSTAADVQAVVWDTLASGLDKDYLKPDD

SEQ ID NO: 1380 - protein, 28 aa, Artificial Sequence
  Description of Artificial Sequence: Synthetic peptide
  C-terminus amidated
LSWAADVQAVVWDTLASGLDKDYLKPDD

SEQ ID NO: 1381 - protein, 28 aa, Artificial Sequence
  Description of Artificial Sequence: Synthetic peptide
  N-terminus acetylated
  C-terminus amidated
LSWAADVQAVVWDTLASGLDKDYLKPDD

SEQ ID NO: 1382 - protein, 28 aa, Artificial Sequence
  Description of Artificial Sequence: Synthetic peptide
  C-terminus amidated
LSTAADMWAVVWDTLASGLDKDYLKPDD

SEQ ID NO: 1383 - protein, 28 aa, Artificial Sequence
  Description of Artificial Sequence: Synthetic peptide
  N-terminus acetylated
  C-terminus amidated
LSTAADMWAVVWDTLASGLDKDYLKPDD

SEQ ID NO: 1384 - protein, 28 aa, Artificial Sequence
  Description of Artificial Sequence: Synthetic peptide
  C-terminus amidated
LSWAADMWAVVWDTLASGLDKDYLKPDD

SEQ ID NO: 1385 - protein, 28 aa, Artificial Sequence
  Description of Artificial Sequence: Synthetic peptide
  N-terminus acetylated
  C-terminus amidated
LSWAADMWAVVWDTLASGLDKDYLKPDD

SEQ ID NO: 1386 - protein, 28 aa, Artificial Sequence
  Description of Artificial Sequence: Synthetic peptide
  C-terminus amidated
LSTAADLWAVVWDTLASGLDKDYLKPDD

SEQ ID NO: 1387 - protein, 28 aa, Artificial Sequence
  Description of Artificial Sequence: Synthetic peptide
  N-terminus acetylated
  C-terminus amidated
LSTAADLWAVVWDTLASGLDKDYLKPDD

SEQ ID NO: 1388 - protein, 28 aa, Artificial Sequence
  Description of Artificial Sequence: Synthetic peptide
  C-terminus amidated
LSWAADLWAVVWDTLASGLDKDYLKPDD

SEQ ID NO: 1389 - protein, 28 aa, Artificial Sequence
  Description of Artificial Sequence: Synthetic peptide
  N-terminus acetylated
  C-terminus amidated
LSWAADLWAVVWDTLASGLDKDYLKPDD

SEQ ID NO: 1390 - protein, 28 aa, Artificial Sequence
  Description of Artificial Sequence: Synthetic peptide
  C-terminus amidated
LSTAADVWAVVWDTLASGLDKDYLKPDD

SEQ ID NO: 1391 - protein, 28 aa, Artificial Sequence
  Description of Artificial Sequence: Synthetic peptide
  N-terminus acetylated
  C-terminus amidated
LSTAADVWAVVWDTLASGLDKDYLKPDD

SEQ ID NO: 1392 - protein, 28 aa, Artificial Sequence
  Description of Artificial Sequence: Synthetic peptide
  C-terminus amidated
LSWAADVWAVVWDTLASGLDKDYLKPDD

SEQ ID NO: 1393 - protein, 28 aa, Artificial Sequence
  Description of Artificial Sequence: Synthetic peptide
  N-terminus acetylated
  C-terminus amidated
LSWAADVWAVVWDTLASGLDKDYLKPDD

SEQ ID NO: 1394 - protein, 28 aa, Artificial Sequence
  Description of Artificial Sequence: Synthetic peptide
  C-terminus amidated
LSTAADMQGVVTDWLASGLDKDYLKPDD

SEQ ID NO: 1395 - protein, 28 aa, Artificial Sequence
  Description of Artificial Sequence: Synthetic peptide
  N-terminus acetylated
  C-terminus amidated
LSTAADMQGVVTDWLASGLDKDYLKPDD

SEQ ID NO: 1396 - protein, 28 aa, Artificial Sequence
  Description of Artificial Sequence: Synthetic peptide
  C-terminus amidated
LSWAADMQGVVTDWLASGLDKDYLKPDD

SEQ ID NO: 1397 - protein, 28 aa, Artificial Sequence
  Description of Artificial Sequence: Synthetic peptide
  N-terminus acetylated
  C-terminus amidated
LSWAADMQGVVTDWLASGLDKDYLKPDD

SEQ ID NO: 1398 - protein, 28 aa, Artificial Sequence
  Description of Artificial Sequence: Synthetic peptide
  C-terminus amidated
LSTAADLQGVVTDWLASGLDKDYLKPDD

SEQ ID NO: 1399 - protein, 28 aa, Artificial Sequence
  Description of Artificial Sequence: Synthetic peptide
  N-terminus acetylated
  C-terminus amidated
LSTAADLQGVVTDWLASGLDKDYLKPDD

SEQ ID NO: 1400 - protein, 28 aa, Artificial Sequence
  Description of Artificial Sequence: Synthetic peptide
  C-terminus amidated
LSWAADLQGVVTDWLASGLDKDYLKPDD

SEQ ID NO: 1401 - protein, 28 aa, Artificial Sequence
  Description of Artificial Sequence: Synthetic peptide
  N-terminus acetylated
  C-terminus amidated
LSWAADLQGVVTDWLASGLDKDYLKPDD

SEQ ID NO: 1402 - protein, 28 aa, Artificial Sequence
  Description of Artificial Sequence: Synthetic peptide
  C-terminus amidated
LSTAADVQGVVTDWLASGLDKDYLKPDD

SEQ ID NO: 1403 - protein, 28 aa, Artificial Sequence
  Description of Artificial Sequence: Synthetic peptide
  N-terminus acetylated
  C-terminus amidated
LSTAADVQGVVTDWLASGLDKDYLKPDD

SEQ ID NO: 1404 - protein, 28 aa, Artificial Sequence
  Description of Artificial Sequence: Synthetic peptide
  C-terminus amidated
LSWAADVQGVVTDWLASGLDKDYLKPDD

SEQ ID NO: 1405 - protein, 28 aa, Artificial Sequence
  Description of Artificial Sequence: Synthetic peptide
  N-terminus acetylated
  C-terminus amidated
LSWAADVQGVVTDWLASGLDKDYLKPDD

SEQ ID NO: 1406 - protein, 28 aa, Artificial Sequence
  Description of Artificial Sequence: Synthetic peptide
  C-terminus amidated
LSTAADMWGVVTDWLASGLDKDYLKPDD

SEQ ID NO: 1407 - protein, 28 aa, Artificial Sequence
  Description of Artificial Sequence: Synthetic peptide
  N-terminus acetylated
  C-terminus amidated
LSTAADMWGVVTDWLASGLDKDYLKPDD

SEQ ID NO: 1408 - protein, 28 aa, Artificial Sequence
  Description of Artificial Sequence: Synthetic peptide
  C-terminus amidated
LSWAADMWGVVTDWLASGLDKDYLKPDD

SEQ ID NO: 1409 - protein, 28 aa, Artificial Sequence
  Description of Artificial Sequence: Synthetic peptide
  N-terminus acetylated
  C-terminus amidated
LSWAADMWGVVTDWLASGLDKDYLKPDD

SEQ ID NO: 1410 - protein, 28 aa, Artificial Sequence
  Description of Artificial Sequence: Synthetic peptide
  C-terminus amidated
LSTAADLWGVVTDWLASGLDKDYLKPDD

SEQ ID NO: 1411 - protein, 28 aa, Artificial Sequence
  Description of Artificial Sequence: Synthetic peptide
  N-terminus acetylated
  C-terminus amidated
LSTAADLWGVVTDWLASGLDKDYLKPDD

SEQ ID NO: 1412 - protein, 28 aa, Artificial Sequence
  Description of Artificial Sequence: Synthetic peptide
  C-terminus amidated
LSWAADLWGVVTDWLASGLDKDYLKPDD

SEQ ID NO: 1413 - protein, 28 aa, Artificial Sequence
  Description of Artificial Sequence: Synthetic peptide
  N-terminus acetylated
  C-terminus amidated
LSWAADLWGVVTDWLASGLDKDYLKPDD

SEQ ID NO: 1414 - protein, 28 aa, Artificial Sequence
  Description of Artificial Sequence: Synthetic peptide
  C-terminus amidated
LSTAADVWGVVTDWLASGLDKDYLKPDD

SEQ ID NO: 1415 - protein, 28 aa, Artificial Sequence
  Description of Artificial Sequence: Synthetic peptide
  N-terminus acetylated
  C-terminus amidated
LSTAADVWGVVTDWLASGLDKDYLKPDD

SEQ ID NO: 1416 - protein, 28 aa, Artificial Sequence
  Description of Artificial Sequence: Synthetic peptide
  C-terminus amidated
LSWAADVWGVVTDWLASGLDKDYLKPDD

SEQ ID NO: 1417 - protein, 28 aa, Artificial Sequence
  Description of Artificial Sequence: Synthetic peptide
  N-terminus acetylated
  C-terminus amidated
LSWAADVWGVVTDWLASGLDKDYLKPDD

SEQ ID NO: 1418 - protein, 28 aa, Artificial Sequence
  Description of Artificial Sequence: Synthetic peptide
  C-terminus amidated
LSTAADMQAVVTDWLASGLDKDYLKPDD

SEQ ID NO: 1419 - protein, 28 aa, Artificial Sequence
  Description of Artificial Sequence: Synthetic peptide
  N-terminus acetylated
  C-terminus amidated
LSTAADMQAVVTDWLASGLDKDYLKPDD

SEQ ID NO: 1420 - protein, 28 aa, Artificial Sequence
  Description of Artificial Sequence: Synthetic peptide
  C-terminus amidated
LSWAADMQAVVTDWLASGLDKDYLKPDD

SEQ ID NO: 1421 - protein, 28 aa, Artificial Sequence
  Description of Artificial Sequence: Synthetic peptide
  N-terminus acetylated
  C-terminus amidated
LSWAADMQAVVTDWLASGLDKDYLKPDD

SEQ ID NO: 1422 - protein, 28 aa, Artificial Sequence
  Description of Artificial Sequence: Synthetic peptide
  C-terminus amidated
LSTAADLQAVVTDWLASGLDKDYLKPDD

SEQ ID NO: 1423 - protein, 28 aa, Artificial Sequence
  Description of Artificial Sequence: Synthetic peptide
  N-terminus acetylated
  C-terminus amidated
LSTAADLQAVVTDWLASGLDKDYLKPDD

SEQ ID NO: 1424 - protein, 28 aa, Artificial Sequence
  Description of Artificial Sequence: Synthetic peptide
  C-terminus amidated
LSWAADLQAVVTDWLASGLDKDYLKPDD

SEQ ID NO: 1425 - protein, 28 aa, Artificial Sequence
  Description of Artificial Sequence: Synthetic peptide
  N-terminus acetylated
  C-terminus amidated
LSWAADLQAVVTDWLASGLDKDYLKPDD

SEQ ID NO: 1426 - protein, 28 aa, Artificial Sequence
  Description of Artificial Sequence: Synthetic peptide
  C-terminus amidated
LSTAADVQAVVTDWLASGLDKDYLKPDD

SEQ ID NO: 1427 - protein, 28 aa, Artificial Sequence
  Description of Artificial Sequence: Synthetic peptide
  N-terminus acetylated
  C-terminus amidated
LSTAADVQAVVTDWLASGLDKDYLKPDD

SEQ ID NO: 1428 - protein, 28 aa, Artificial Sequence
  Description of Artificial Sequence: Synthetic peptide
  C-terminus amidated
LSWAADVQAVVTDWLASGLDKDYLKPDD

SEQ ID NO: 1429 - protein, 28 aa, Artificial Sequence
  Description of Artificial Sequence: Synthetic peptide
  N-terminus acetylated
  C-terminus amidated
LSWAADVQAVVTDWLASGLDKDYLKPDD

SEQ ID NO: 1430 - protein, 28 aa, Artificial Sequence
  Description of Artificial Sequence: Synthetic peptide
  C-terminus amidated
LSTAADMWAVVTDWLASGLDKDYLKPDD

SEQ ID NO: 1431 - protein, 28 aa, Artificial Sequence
  Description of Artificial Sequence: Synthetic peptide
  N-terminus acetylated
  C-terminus amidated
LSTAADMWAVVTDWLASGLDKDYLKPDD

SEQ ID NO: 1432 - protein, 28 aa, Artificial Sequence
  Description of Artificial Sequence: Synthetic peptide
  C-terminus amidated
LSWAADMWAVVTDWLASGLDKDYLKPDD

SEQ ID NO: 1433 - protein, 28 aa, Artificial Sequence
  Description of Artificial Sequence: Synthetic peptide
  N-terminus acetylated
  C-terminus amidated
LSWAADMWAVVTDWLASGLDKDYLKPDD

SEQ ID NO: 1434 - protein, 28 aa, Artificial Sequence
  Description of Artificial Sequence: Synthetic peptide
  C-terminus amidated
LSTAADLWAVVTDWLASGLDKDYLKPDD

SEQ ID NO: 1435 - protein, 28 aa, Artificial Sequence
  Description of Artificial Sequence: Synthetic peptide
  N-terminus acetylated
  C-terminus amidated
LSTAADLWAVVTDWLASGLDKDYLKPDD

SEQ ID NO: 1436 - protein, 28 aa, Artificial Sequence
  Description of Artificial Sequence: Synthetic peptide
  C-terminus amidated
LSWAADLWAVVTDWLASGLDKDYLKPDD

SEQ ID NO: 1437 - protein, 28 aa, Artificial Sequence
  Description of Artificial Sequence: Synthetic peptide
  N-terminus acetylated
  C-terminus amidated
LSWAADLWAVVTDWLASGLDKDYLKPDD

SEQ ID NO: 1438 - protein, 28 aa, Artificial Sequence
  Description of Artificial Sequence: Synthetic peptide
  C-terminus amidated
LSTAADVWAVVTDWLASGLDKDYLKPDD

SEQ ID NO: 1439 - protein, 28 aa, Artificial Sequence
  Description of Artificial Sequence: Synthetic peptide
  N-terminus acetylated
  C-terminus amidated
LSTAADVWAVVTDWLASGLDKDYLKPDD

SEQ ID NO: 1440 - protein, 28 aa, Artificial Sequence
  Description of Artificial Sequence: Synthetic peptide
  C-terminus amidated
LSWAADVWAVVTDWLASGLDKDYLKPDD

SEQ ID NO: 1441 - protein, 28 aa, Artificial Sequence
  Description of Artificial Sequence: Synthetic peptide
  N-terminus acetylated
  C-terminus amidated
LSWAADVWAVVTDWLASGLDKDYLKPDD

SEQ ID NO: 1442 - protein, 28 aa, Artificial Sequence
  Description of Artificial Sequence: Synthetic peptide
  C-terminus amidated
LSTAADMQGVVWDWLASGLDKDYLKPDD

SEQ ID NO: 1443 - protein, 28 aa, Artificial Sequence
  Description of Artificial Sequence: Synthetic peptide
  N-terminus acetylated
  C-terminus amidated
LSTAADMQGVVWDWLASGLDKDYLKPDD

SEQ ID NO: 1444 - protein, 28 aa, Artificial Sequence
  Description of Artificial Sequence: Synthetic peptide
  C-terminus amidated
LSWAADMQGVVWDWLASGLDKDYLKPDD

SEQ ID NO: 1445 - protein, 28 aa, Artificial Sequence
  Description of Artificial Sequence: Synthetic peptide
  N-terminus acetylated
  C-terminus amidated
LSWAADMQGVVWDWLASGLDKDYLKPDD

SEQ ID NO: 1446 - protein, 28 aa, Artificial Sequence
  Description of Artificial Sequence: Synthetic peptide
  C-terminus amidated
LSTAADLQGVVWDWLASGLDKDYLKPDD

SEQ ID NO: 1447 - protein, 28 aa, Artificial Sequence
  Description of Artificial Sequence: Synthetic peptide
  N-terminus acetylated
  C-terminus amidated
LSTAADLQGVVWDWLASGLDKDYLKPDD

SEQ ID NO: 1448 - protein, 28 aa, Artificial Sequence
  Description of Artificial Sequence: Synthetic peptide
  C-terminus amidated
LSWAADLQGVVWDWLASGLDKDYLKPDD

SEQ ID NO: 1449 - protein, 28 aa, Artificial Sequence
  Description of Artificial Sequence: Synthetic peptide
  N-terminus acetylated
  C-terminus amidated
LSWAADLQGVVWDWLASGLDKDYLKPDD

SEQ ID NO: 1450 - protein, 28 aa, Artificial Sequence
  Description of Artificial Sequence: Synthetic peptide
  C-terminus amidated
LSTAADVQGVVWDWLASGLDKDYLKPDD

SEQ ID NO: 1451 - protein, 28 aa, Artificial Sequence
  Description of Artificial Sequence: Synthetic peptide
  N-terminus acetylated
  C-terminus amidated
LSTAADVQGVVWDWLASGLDKDYLKPDD

SEQ ID NO: 1452 - protein, 28 aa, Artificial Sequence
  Description of Artificial Sequence: Synthetic peptide
  C-terminus amidated
LSWAADVQGVVWDWLASGLDKDYLKPDD

SEQ ID NO: 1453 - protein, 28 aa, Artificial Sequence
  Description of Artificial Sequence: Synthetic peptide
  N-terminus acetylated
  C-terminus amidated
LSWAADVQGVVWDWLASGLDKDYLKPDD

SEQ ID NO: 1454 - protein, 28 aa, Artificial Sequence
  Description of Artificial Sequence: Synthetic peptide
  C-terminus amidated
LSTAADMWGVVWDWLASGLDKDYLKPDD

SEQ ID NO: 1455 - protein, 28 aa, Artificial Sequence
  Description of Artificial Sequence: Synthetic peptide
  N-terminus acetylated
  C-terminus amidated
LSTAADMWGVVWDWLASGLDKDYLKPDD

SEQ ID NO: 1456 - protein, 28 aa, Artificial Sequence
  Description of Artificial Sequence: Synthetic peptide
  C-terminus amidated
LSWAADMWGVVWDWLASGLDKDYLKPDD

SEQ ID NO: 1457 - protein, 28 aa, Artificial Sequence
  Description of Artificial Sequence: Synthetic peptide
  N-terminus acetylated
  C-terminus amidated
LSWAADMWGVVWDWLASGLDKDYLKPDD

SEQ ID NO: 1458 - protein, 28 aa, Artificial Sequence
  Description of Artificial Sequence: Synthetic peptide
  C-terminus amidated
LSTAADLWGVVWDWLASGLDKDYLKPDD

SEQ ID NO: 1459 - protein, 28 aa, Artificial Sequence
  Description of Artificial Sequence: Synthetic peptide
  N-terminus acetylated
  C-terminus amidated
LSTAADLWGVVWDWLASGLDKDYLKPDD

SEQ ID NO: 1460 - protein, 28 aa, Artificial Sequence
  Description of Artificial Sequence: Synthetic peptide
  C-terminus amidated
LSWAADLWGVVWDWLASGLDKDYLKPDD

SEQ ID NO: 1461 - protein, 28 aa, Artificial Sequence
  Description of Artificial Sequence: Synthetic peptide
  N-terminus acetylated
  C-terminus amidated
LSWAADLWGVVWDWLASGLDKDYLKPDD

SEQ ID NO: 1462 - protein, 28 aa, Artificial Sequence
  Description of Artificial Sequence: Synthetic peptide
  C-terminus amidated
LSTAADVWGVVWDWLASGLDKDYLKPDD

SEQ ID NO: 1463 - protein, 28 aa, Artificial Sequence
  Description of Artificial Sequence: Synthetic peptide
  N-terminus acetylated
  C-terminus amidated
LSTAADVWGVVWDWLASGLDKDYLKPDD

SEQ ID NO: 1464 - protein, 28 aa, Artificial Sequence
  Description of Artificial Sequence: Synthetic peptide
  C-terminus amidated
LSWAADVWGVVWDWLASGLDKDYLKPDD

SEQ ID NO: 1465 - protein, 28 aa, Artificial Sequence
  Description of Artificial Sequence: Synthetic peptide
  N-terminus acetylated
  C-terminus amidated
LSWAADVWGVVWDWLASGLDKDYLKPDD

SEQ ID NO: 1466 - protein, 28 aa, Artificial Sequence
  Description of Artificial Sequence: Synthetic peptide
  C-terminus amidated
LSTAADMQAVVWDWLASGLDKDYLKPDD

SEQ ID NO: 1467 - protein, 28 aa, Artificial Sequence
  Description of Artificial Sequence: Synthetic peptide
  N-terminus acetylated
  C-terminus amidated
LSTAADMQAVVWDWLASGLDKDYLKPDD

SEQ ID NO: 1468 - protein, 28 aa, Artificial Sequence
  Description of Artificial Sequence: Synthetic peptide
  C-terminus amidated
LSWAADMQAVVWDWLASGLDKDYLKPDD

SEQ ID NO: 1469 - protein, 28 aa, Artificial Sequence
  Description of Artificial Sequence: Synthetic peptide
  N-terminus acetylated
  C-terminus amidated
LSWAADMQAVVWDWLASGLDKDYLKPDD

SEQ ID NO: 1470 - protein, 28 aa, Artificial Sequence
  Description of Artificial Sequence: Synthetic peptide
  C-terminus amidated
LSTAADLQAVVWDWLASGLDKDYLKPDD

SEQ ID NO: 1471 - protein, 28 aa, Artificial Sequence
  Description of Artificial Sequence: Synthetic peptide
  N-terminus acetylated
  C-terminus amidated
LSTAADLQAVVWDWLASGLDKDYLKPDD

SEQ ID NO: 1472 - protein, 28 aa, Artificial Sequence
  Description of Artificial Sequence: Synthetic peptide
  C-terminus amidated
LSWAADLQAVVWDWLASGLDKDYLKPDD

SEQ ID NO: 1473 - protein, 28 aa, Artificial Sequence
  Description of Artificial Sequence: Synthetic peptide
  N-terminus acetylated
  C-terminus amidated
LSWAADLQAVVWDWLASGLDKDYLKPDD

SEQ ID NO: 1474 - protein, 28 aa, Artificial Sequence
  Description of Artificial Sequence: Synthetic peptide
  C-terminus amidated
LSTAADVQAVVWDWLASGLDKDYLKPDD

SEQ ID NO: 1475 - protein, 28 aa, Artificial Sequence
  Description of Artificial Sequence: Synthetic peptide
  N-terminus acetylated
  C-terminus amidated
LSTAADVQAVVWDWLASGLDKDYLKPDD

SEQ ID NO: 1476 - protein, 28 aa, Artificial Sequence
  Description of Artificial Sequence: Synthetic peptide
  C-terminus amidated
LSWAADVQAVVWDWLASGLDKDYLKPDD

SEQ ID NO: 1477 - protein, 28 aa, Artificial Sequence
  Description of Artificial Sequence: Synthetic peptide
  N-terminus acetylated
  C-terminus amidated
LSWAADVQAVVWDWLASGLDKDYLKPDD

SEQ ID NO: 1478 - protein, 28 aa, Artificial Sequence
  Description of Artificial Sequence: Synthetic peptide
  C-terminus amidated
LSTAADMWAVVWDWLASGLDKDYLKPDD

SEQ ID NO: 1479 - protein, 28 aa, Artificial Sequence
  Description of Artificial Sequence: Synthetic peptide
  N-terminus acetylated
  C-terminus amidated
LSTAADMWAVVWDWLASGLDKDYLKPDD

SEQ ID NO: 1480 - protein, 28 aa, Artificial Sequence
  Description of Artificial Sequence: Synthetic peptide
  C-terminus amidated
LSWAADMWAVVWDWLASGLDKDYLKPDD

SEQ ID NO: 1481 - protein, 28 aa, Artificial Sequence
  Description of Artificial Sequence: Synthetic peptide
  N-terminus acetylated
  C-terminus amidated
LSWAADMWAVVWDWLASGLDKDYLKPDD

SEQ ID NO: 1482 - protein, 28 aa, Artificial Sequence
  Description of Artificial Sequence: Synthetic peptide
  C-terminus amidated
LSTAADLWAVVWDWLASGLDKDYLKPDD

SEQ ID NO: 1483 - protein, 28 aa, Artificial Sequence
  Description of Artificial Sequence: Synthetic peptide
  N-terminus acetylated
  C-terminus amidated
LSTAADLWAVVWDWLASGLDKDYLKPDD

SEQ ID NO: 1484 - protein, 28 aa, Artificial Sequence
  Description of Artificial Sequence: Synthetic peptide
  C-terminus amidated
LSWAADLWAVVWDWLASGLDKDYLKPDD

SEQ ID NO: 1485 - protein, 28 aa, Artificial Sequence
  Description of Artificial Sequence: Synthetic peptide
  N-terminus acetylated
  C-terminus amidated
LSWAADLWAVVWDWLASGLDKDYLKPDD

SEQ ID NO: 1486 - protein, 28 aa, Artificial Sequence
  Description of Artificial Sequence: Synthetic peptide
  C-terminus amidated
LSTAADVWAVVWDWLASGLDKDYLKPDD

SEQ ID NO: 1487 - protein, 28 aa, Artificial Sequence
  Description of Artificial Sequence: Synthetic peptide
  N-terminus acetylated
  C-terminus amidated
LSTAADVWAVVWDWLASGLDKDYLKPDD

SEQ ID NO: 1488 - protein, 28 aa, Artificial Sequence
  Description of Artificial Sequence: Synthetic peptide
  C-terminus amidated
LSWAADVWAVVWDWLASGLDKDYLKPDD

SEQ ID NO: 1489 - protein, 28 aa, Artificial Sequence
  Description of Artificial Sequence: Synthetic peptide
  N-terminus acetylated
  C-terminus amidated
LSWAADVWAVVWDWLASGLDKDYLKPDD

SEQ ID NO: 1490 - protein, 28 aa, Artificial Sequence
  Description of Artificial Sequence: Synthetic peptide
  C-terminus amidated
LSTAADMQGVVTDGVASGLDKDYLKPDD

SEQ ID NO: 1491 - protein, 28 aa, Artificial Sequence
  Description of Artificial Sequence: Synthetic peptide
  N-terminus acetylated
  C-terminus amidated
LSTAADMQGVVTDGVASGLDKDYLKPDD

SEQ ID NO: 1492 - protein, 28 aa, Artificial Sequence
  Description of Artificial Sequence: Synthetic peptide
  C-terminus amidated
LSWAADMQGVVTDGVASGLDKDYLKPDD

SEQ ID NO: 1493 - protein, 28 aa, Artificial Sequence
  Description of Artificial Sequence: Synthetic peptide
  N-terminus acetylated
  C-terminus amidated
LSWAADMQGVVTDGVASGLDKDYLKPDD

SEQ ID NO: 1494 - protein, 28 aa, Artificial Sequence
  Description of Artificial Sequence: Synthetic peptide
  C-terminus amidated
LSTAADLQGVVTDGVASGLDKDYLKPDD

SEQ ID NO: 1495 - protein, 28 aa, Artificial Sequence
  Description of Artificial Sequence: Synthetic peptide
  N-terminus acetylated
  C-terminus amidated
LSTAADLQGVVTDGVASGLDKDYLKPDD

SEQ ID NO: 1496 - protein, 28 aa, Artificial Sequence
  Description of Artificial Sequence: Synthetic peptide
  C-terminus amidated
LSWAADLQGVVTDGVASGLDKDYLKPDD

SEQ ID NO: 1497 - protein, 28 aa, Artificial Sequence
  Description of Artificial Sequence: Synthetic peptide
  N-terminus acetylated
  C-terminus amidated
LSWAADLQGVVTDGVASGLDKDYLKPDD

SEQ ID NO: 1498 - protein, 28 aa, Artificial Sequence
  Description of Artificial Sequence: Synthetic peptide
  C-terminus amidated
LSTAADVQGVVTDGVASGLDKDYLKPDD

SEQ ID NO: 1499 - protein, 28 aa, Artificial Sequence
  Description of Artificial Sequence: Synthetic peptide
  N-terminus acetylated
  C-terminus amidated
LSTAADVQGVVTDGVASGLDKDYLKPDD

SEQ ID NO: 1500 - protein, 28 aa, Artificial Sequence
  Description of Artificial Sequence: Synthetic peptide
  C-terminus amidated
LSWAADVQGVVTDGVASGLDKDYLKPDD

SEQ ID NO: 1501 - protein, 28 aa, Artificial Sequence
  Description of Artificial Sequence: Synthetic peptide
  N-terminus acetylated
  C-terminus amidated
LSWAADVQGVVTDGVASGLDKDYLKPDD

SEQ ID NO: 1502 - protein, 28 aa, Artificial Sequence
  Description of Artificial Sequence: Synthetic peptide
  C-terminus amidated
LSTAADMWGVVTDGVASGLDKDYLKPDD

SEQ ID NO: 1503 - protein, 28 aa, Artificial Sequence
  Description of Artificial Sequence: Synthetic peptide
  N-terminus acetylated
  C-terminus amidated
LSTAADMWGVVTDGVASGLDKDYLKPDD

SEQ ID NO: 1504 - protein, 28 aa, Artificial Sequence
  Description of Artificial Sequence: Synthetic peptide
  C-terminus amidated
LSWAADMWGVVTDGVASGLDKDYLKPDD

SEQ ID NO: 1505 - protein, 28 aa, Artificial Sequence
  Description of Artificial Sequence: Synthetic peptide
  N-terminus acetylated
  C-terminus amidated
LSWAADMWGVVTDGVASGLDKDYLKPDD

SEQ ID NO: 1506 - protein, 28 aa, Artificial Sequence
  Description of Artificial Sequence: Synthetic peptide
  C-terminus amidated
LSTAADLWGVVTDGVASGLDKDYLKPDD

SEQ ID NO: 1507 - protein, 28 aa, Artificial Sequence
  Description of Artificial Sequence: Synthetic peptide
  N-terminus acetylated
  C-terminus amidated
LSTAADLWGVVTDGVASGLDKDYLKPDD

SEQ ID NO: 1508 - protein, 28 aa, Artificial Sequence
  Description of Artificial Sequence: Synthetic peptide
  C-terminus amidated
LSWAADLWGVVTDGVASGLDKDYLKPDD

SEQ ID NO: 1509 - protein, 28 aa, Artificial Sequence
  Description of Artificial Sequence: Synthetic peptide
  N-terminus acetylated
  C-terminus amidated
LSWAADLWGVVTDGVASGLDKDYLKPDD

SEQ ID NO: 1510 - protein, 28 aa, Artificial Sequence
  Description of Artificial Sequence: Synthetic peptide
  C-terminus amidated
LSTAADVWGVVTDGVASGLDKDYLKPDD

SEQ ID NO: 1511 - protein, 28 aa, Artificial Sequence
  Description of Artificial Sequence: Synthetic peptide
  N-terminus acetylated
  C-terminus amidated
LSTAADVWGVVTDGVASGLDKDYLKPDD

SEQ ID NO: 1512 - protein, 28 aa, Artificial Sequence
  Description of Artificial Sequence: Synthetic peptide
  C-terminus amidated
LSWAADVWGVVTDGVASGLDKDYLKPDD

SEQ ID NO: 1513 - protein, 28 aa, Artificial Sequence
  Description of Artificial Sequence: Synthetic peptide
  N-terminus acetylated
  C-terminus amidated
LSWAADVWGVVTDGVASGLDKDYLKPDD

SEQ ID NO: 1514 - protein, 28 aa, Artificial Sequence
  Description of Artificial Sequence: Synthetic peptide
  C-terminus amidated
LSTAADMQAVVTDGVASGLDKDYLKPDD

SEQ ID NO: 1515 - protein, 28 aa, Artificial Sequence
  Description of Artificial Sequence: Synthetic peptide
  N-terminus acetylated
  C-terminus amidated
LSTAADMQAVVTDGVASGLDKDYLKPDD

SEQ ID NO: 1516 - protein, 28 aa, Artificial Sequence
  Description of Artificial Sequence: Synthetic peptide
  C-terminus amidated
LSWAADMQAVVTDGVASGLDKDYLKPDD

SEQ ID NO: 1517 - protein, 28 aa, Artificial Sequence
  Description of Artificial Sequence: Synthetic peptide
  N-terminus acetylated
  C-terminus amidated
LSWAADMQAVVTDGVASGLDKDYLKPDD

SEQ ID NO: 1518 - protein, 28 aa, Artificial Sequence
  Description of Artificial Sequence: Synthetic peptide
  C-terminus amidated
LSTAADLQAVVTDGVASGLDKDYLKPDD

SEQ ID NO: 1519 - protein, 28 aa, Artificial Sequence
  Description of Artificial Sequence: Synthetic peptide
  N-terminus acetylated
  C-terminus amidated
LSTAADLQAVVTDGVASGLDKDYLKPDD

SEQ ID NO: 1520 - protein, 28 aa, Artificial Sequence
  Description of Artificial Sequence: Synthetic peptide
  C-terminus amidated
LSWAADLQAVVTDGVASGLDKDYLKPDD

SEQ ID NO: 1521 - protein, 28 aa, Artificial Sequence
  Description of Artificial Sequence: Synthetic peptide
  N-terminus acetylated
  C-terminus amidated
LSWAADLQAVVTDGVASGLDKDYLKPDD

SEQ ID NO: 1522 - protein, 28 aa, Artificial Sequence
  Description of Artificial Sequence: Synthetic peptide
  C-terminus amidated
LSTAADVQAVVTDGVASGLDKDYLKPDD

SEQ ID NO: 1523 - protein, 28 aa, Artificial Sequence
  Description of Artificial Sequence: Synthetic peptide
  N-terminus acetylated
  C-terminus amidated
LSTAADVQAVVTDGVASGLDKDYLKPDD

SEQ ID NO: 1524 - protein, 28 aa, Artificial Sequence
  Description of Artificial Sequence: Synthetic peptide
  C-terminus amidated
LSWAADVQAVVTDGVASGLDKDYLKPDD

SEQ ID NO: 1525 - protein, 28 aa, Artificial Sequence
  Description of Artificial Sequence: Synthetic peptide
  N-terminus acetylated
  C-terminus amidated
LSWAADVQAVVTDGVASGLDKDYLKPDD

SEQ ID NO: 1526 - protein, 28 aa, Artificial Sequence
  Description of Artificial Sequence: Synthetic peptide
  C-terminus amidated
LSTAADMWAVVTDGVASGLDKDYLKPDD

SEQ ID NO: 1527 - protein, 28 aa, Artificial Sequence
  Description of Artificial Sequence: Synthetic peptide
  N-terminus acetylated
  C-terminus amidated
LSTAADMWAVVTDGVASGLDKDYLKPDD

SEQ ID NO: 1528 - protein, 28 aa, Artificial Sequence
  Description of Artificial Sequence: Synthetic peptide
  C-terminus amidated
LSWAADMWAVVTDGVASGLDKDYLKPDD

SEQ ID NO: 1529 - protein, 28 aa, Artificial Sequence
  Description of Artificial Sequence: Synthetic peptide
  N-terminus acetylated
  C-terminus amidated
LSWAADMWAVVTDGVASGLDKDYLKPDD

SEQ ID NO: 1530 - protein, 28 aa, Artificial Sequence
  Description of Artificial Sequence: Synthetic peptide
  C-terminus amidated
LSTAADLWAVVTDGVASGLDKDYLKPDD

SEQ ID NO: 1531 - protein, 28 aa, Artificial Sequence
  Description of Artificial Sequence: Synthetic peptide
  N-terminus acetylated
  C-terminus amidated
LSTAADLWAVVTDGVASGLDKDYLKPDD

SEQ ID NO: 1532 - protein, 28 aa, Artificial Sequence
  Description of Artificial Sequence: Synthetic peptide
  C-terminus amidated
LSWAADLWAVVTDGVASGLDKDYLKPDD

SEQ ID NO: 1533 - protein, 28 aa, Artificial Sequence
  Description of Artificial Sequence: Synthetic peptide
  N-terminus acetylated
  C-terminus amidated
LSWAADLWAVVTDGVASGLDKDYLKPDD

SEQ ID NO: 1534 - protein, 28 aa, Artificial Sequence
  Description of Artificial Sequence: Synthetic peptide
  C-terminus amidated
LSTAADVWAVVTDGVASGLDKDYLKPDD

SEQ ID NO: 1535 - protein, 28 aa, Artificial Sequence
  Description of Artificial Sequence: Synthetic peptide
  N-terminus acetylated
  C-terminus amidated
LSTAADVWAVVTDGVASGLDKDYLKPDD

SEQ ID NO: 1536 - protein, 28 aa, Artificial Sequence
  Description of Artificial Sequence: Synthetic peptide
  C-terminus amidated
LSWAADVWAVVTDGVASGLDKDYLKPDD

SEQ ID NO: 1537 - protein, 28 aa, Artificial Sequence
  Description of Artificial Sequence: Synthetic peptide
  N-terminus acetylated
  C-terminus amidated
LSWAADVWAVVTDGVASGLDKDYLKPDD

SEQ ID NO: 1538 - protein, 28 aa, Artificial Sequence
  Description of Artificial Sequence: Synthetic peptide
  C-terminus amidated
LSTAADMQGVVWDGVASGLDKDYLKPDD

SEQ ID NO: 1539 - protein, 28 aa, Artificial Sequence
  Description of Artificial Sequence: Synthetic peptide
  N-terminus acetylated
  C-terminus amidated
LSTAADMQGVVWDGVASGLDKDYLKPDD

SEQ ID NO: 1540 - protein, 28 aa, Artificial Sequence
  Description of Artificial Sequence: Synthetic peptide
  C-terminus amidated
LSWAADMQGVVWDGVASGLDKDYLKPDD

SEQ ID NO: 1541 - protein, 28 aa, Artificial Sequence
  Description of Artificial Sequence: Synthetic peptide
  N-terminus acetylated
  C-terminus amidated
LSWAADMQGVVWDGVASGLDKDYLKPDD

SEQ ID NO: 1542 - protein, 28 aa, Artificial Sequence
  Description of Artificial Sequence: Synthetic peptide
  C-terminus amidated
LSTAADLQGVVWDGVASGLDKDYLKPDD

SEQ ID NO: 1543 - protein, 28 aa, Artificial Sequence
  Description of Artificial Sequence: Synthetic peptide
  N-terminus acetylated
  C-terminus amidated
LSTAADLQGVVWDGVASGLDKDYLKPDD

SEQ ID NO: 1544 - protein, 28 aa, Artificial Sequence
  Description of Artificial Sequence: Synthetic peptide
  C-terminus amidated
LSWAADLQGVVWDGVASGLDKDYLKPDD

SEQ ID NO: 1545 - protein, 28 aa, Artificial Sequence
  Description of Artificial Sequence: Synthetic peptide
  N-terminus acetylated
  C-terminus amidated
LSWAADLQGVVWDGVASGLDKDYLKPDD

SEQ ID NO: 1546 - protein, 28 aa, Artificial Sequence
  Description of Artificial Sequence: Synthetic peptide
  C-terminus amidated
LSTAADVQGVVWDGVASGLDKDYLKPDD

SEQ ID NO: 1547 - protein, 28 aa, Artificial Sequence
  Description of Artificial Sequence: Synthetic peptide
  N-terminus acetylated
  C-terminus amidated
LSTAADVQGVVWDGVASGLDKDYLKPDD

SEQ ID NO: 1548 - protein, 28 aa, Artificial Sequence
  Description of Artificial Sequence: Synthetic peptide
  C-terminus amidated
LSWAADVQGVVWDGVASGLDKDYLKPDD

SEQ ID NO: 1549 - protein, 28 aa, Artificial Sequence
  Description of Artificial Sequence: Synthetic peptide
  N-terminus acetylated
  C-terminus amidated
LSWAADVQGVVWDGVASGLDKDYLKPDD

SEQ ID NO: 1550 - protein, 28 aa, Artificial Sequence
  Description of Artificial Sequence: Synthetic peptide
  C-terminus amidated
LSTAADMWGVVWDGVASGLDKDYLKPDD

SEQ ID NO: 1551 - protein, 28 aa, Artificial Sequence
  Description of Artificial Sequence: Synthetic peptide
  N-terminus acetylated
  C-terminus amidated
LSTAADMWGVVWDGVASGLDKDYLKPDD

SEQ ID NO: 1552 - protein, 28 aa, Artificial Sequence
  Description of Artificial Sequence: Synthetic peptide
  C-terminus amidated
LSWAADMWGVVWDGVASGLDKDYLKPDD

SEQ ID NO: 1553 - protein, 28 aa, Artificial Sequence
  Description of Artificial Sequence: Synthetic peptide
  N-terminus acetylated
  C-terminus amidated
LSWAADMWGVVWDGVASGLDKDYLKPDD

SEQ ID NO: 1554 - protein, 28 aa, Artificial Sequence
  Description of Artificial Sequence: Synthetic peptide
  C-terminus amidated
LSTAADLWGVVWDGVASGLDKDYLKPDD

SEQ ID NO: 1555 - protein, 28 aa, Artificial Sequence
  Description of Artificial Sequence: Synthetic peptide
  N-terminus acetylated
  C-terminus amidated
LSTAADLWGVVWDGVASGLDKDYLKPDD

SEQ ID NO: 1556 - protein, 28 aa, Artificial Sequence
  Description of Artificial Sequence: Synthetic peptide
  C-terminus amidated
LSWAADLWGVVWDGVASGLDKDYLKPDD

SEQ ID NO: 1557 - protein, 28 aa, Artificial Sequence
  Description of Artificial Sequence: Synthetic peptide
  N-terminus acetylated
  C-terminus amidated
LSWAADLWGVVWDGVASGLDKDYLKPDD

SEQ ID NO: 1558 - protein, 28 aa, Artificial Sequence
  Description of Artificial Sequence: Synthetic peptide
  C-terminus amidated
LSTAADVWGVVWDGVASGLDKDYLKPDD

SEQ ID NO: 1559 - protein, 28 aa, Artificial Sequence
  Description of Artificial Sequence: Synthetic peptide
  N-terminus acetylated
  C-terminus amidated
LSTAADVWGVVWDGVASGLDKDYLKPDD

SEQ ID NO: 1560 - protein, 28 aa, Artificial Sequence
  Description of Artificial Sequence: Synthetic peptide
  C-terminus amidated
LSWAADVWGVVWDGVASGLDKDYLKPDD

SEQ ID NO: 1561 - protein, 28 aa, Artificial Sequence
  Description of Artificial Sequence: Synthetic peptide
  N-terminus acetylated
  C-terminus amidated
LSWAADVWGVVWDGVASGLDKDYLKPDD

SEQ ID NO: 1562 - protein, 28 aa, Artificial Sequence
  Description of Artificial Sequence: Synthetic peptide
  C-terminus amidated
LSTAADMQAVVWDGVASGLDKDYLKPDD

SEQ ID NO: 1563 - protein, 28 aa, Artificial Sequence
  Description of Artificial Sequence: Synthetic peptide
  N-terminus acetylated
  C-terminus amidated
LSTAADMQAVVWDGVASGLDKDYLKPDD

SEQ ID NO: 1564 - protein, 28 aa, Artificial Sequence
  Description of Artificial Sequence: Synthetic peptide
  C-terminus amidated
LSWAADMQAVVWDGVASGLDKDYLKPDD

SEQ ID NO: 1565 - protein, 28 aa, Artificial Sequence
  Description of Artificial Sequence: Synthetic peptide
  N-terminus acetylated
  C-terminus amidated
LSWAADMQAVVWDGVASGLDKDYLKPDD

SEQ ID NO: 1566 - protein, 28 aa, Artificial Sequence
  Description of Artificial Sequence: Synthetic peptide
  C-terminus amidated
LSTAADLQAVVWDGVASGLDKDYLKPDD

SEQ ID NO: 1567 - protein, 28 aa, Artificial Sequence
  Description of Artificial Sequence: Synthetic peptide
  N-terminus acetylated
  C-terminus amidated
LSTAADLQAVVWDGVASGLDKDYLKPDD

SEQ ID NO: 1568 - protein, 28 aa, Artificial Sequence
  Description of Artificial Sequence: Synthetic peptide
  C-terminus amidated
LSWAADLQAVVWDGVASGLDKDYLKPDD

SEQ ID NO: 1569 - protein, 28 aa, Artificial Sequence
  Description of Artificial Sequence: Synthetic peptide
  N-terminus acetylated
  C-terminus amidated
LSWAADLQAVVWDGVASGLDKDYLKPDD

SEQ ID NO: 1570 - protein, 28 aa, Artificial Sequence
  Description of Artificial Sequence: Synthetic peptide
  C-terminus amidated
LSTAADVQAVVWDGVASGLDKDYLKPDD

SEQ ID NO: 1571 - protein, 28 aa, Artificial Sequence
  Description of Artificial Sequence: Synthetic peptide
  N-terminus acetylated
  C-terminus amidated
LSTAADVQAVVWDGVASGLDKDYLKPDD

SEQ ID NO: 1572 - protein, 28 aa, Artificial Sequence
  Description of Artificial Sequence: Synthetic peptide
  C-terminus amidated
LSWAADVQAVVWDGVASGLDKDYLKPDD

SEQ ID NO: 1573 - protein, 28 aa, Artificial Sequence
  Description of Artificial Sequence: Synthetic peptide
  N-terminus acetylated
  C-terminus amidated
LSWAADVQAVVWDGVASGLDKDYLKPDD

SEQ ID NO: 1574 - protein, 28 aa, Artificial Sequence
  Description of Artificial Sequence: Synthetic peptide
  C-terminus amidated
LSTAADMWAVVWDGVASGLDKDYLKPDD

SEQ ID NO: 1575 - protein, 28 aa, Artificial Sequence
  Description of Artificial Sequence: Synthetic peptide
  N-terminus acetylated
  C-terminus amidated
LSTAADMWAVVWDGVASGLDKDYLKPDD

SEQ ID NO: 1576 - protein, 28 aa, Artificial Sequence
  Description of Artificial Sequence: Synthetic peptide
  C-terminus amidated
LSWAADMWAVVWDGVASGLDKDYLKPDD

SEQ ID NO: 1577 - protein, 28 aa, Artificial Sequence
  Description of Artificial Sequence: Synthetic peptide
  N-terminus acetylated
  C-terminus amidated
LSWAADMWAVVWDGVASGLDKDYLKPDD

SEQ ID NO: 1578 - protein, 28 aa, Artificial Sequence
  Description of Artificial Sequence: Synthetic peptide
  C-terminus amidated
LSTAADLWAVVWDGVASGLDKDYLKPDD

SEQ ID NO: 1579 - protein, 28 aa, Artificial Sequence
  Description of Artificial Sequence: Synthetic peptide
  N-terminus acetylated
  C-terminus amidated
LSTAADLWAVVWDGVASGLDKDYLKPDD

SEQ ID NO: 1580 - protein, 28 aa, Artificial Sequence
  Description of Artificial Sequence: Synthetic peptide
  C-terminus amidated
LSWAADLWAVVWDGVASGLDKDYLKPDD

SEQ ID NO: 1581 - protein, 28 aa, Artificial Sequence
  Description of Artificial Sequence: Synthetic peptide
  N-terminus acetylated
  C-terminus amidated
LSWAADLWAVVWDGVASGLDKDYLKPDD

SEQ ID NO: 1582 - protein, 28 aa, Artificial Sequence
  Description of Artificial Sequence: Synthetic peptide
  C-terminus amidated
LSTAADVWAVVWDGVASGLDKDYLKPDD

SEQ ID NO: 1583 - protein, 28 aa, Artificial Sequence
  Description of Artificial Sequence: Synthetic peptide
  N-terminus acetylated
  C-terminus amidated
LSTAADVWAVVWDGVASGLDKDYLKPDD

SEQ ID NO: 1584 - protein, 28 aa, Artificial Sequence
  Description of Artificial Sequence: Synthetic peptide
  C-terminus amidated
LSWAADVWAVVWDGVASGLDKDYLKPDD

SEQ ID NO: 1585 - protein, 28 aa, Artificial Sequence
  Description of Artificial Sequence: Synthetic peptide
  N-terminus acetylated
  C-terminus amidated
LSWAADVWAVVWDGVASGLDKDYLKPDD

SEQ ID NO: 1586 - protein, 28 aa, Artificial Sequence
  Description of Artificial Sequence: Synthetic peptide
  C-terminus amidated
LSTAADMQGVVTDTVASGLDKDYLKPDD

SEQ ID NO: 1587 - protein, 28 aa, Artificial Sequence
  Description of Artificial Sequence: Synthetic peptide
  N-terminus acetylated
  C-terminus amidated
LSTAADMQGVVTDTVASGLDKDYLKPDD

SEQ ID NO: 1588 - protein, 28 aa, Artificial Sequence
  Description of Artificial Sequence: Synthetic peptide
  C-terminus amidated
LSWAADMQGVVTDTVASGLDKDYLKPDD

SEQ ID NO: 1589 - protein, 28 aa, Artificial Sequence
  Description of Artificial Sequence: Synthetic peptide
  N-terminus acetylated
  C-terminus amidated
LSWAADMQGVVTDTVASGLDKDYLKPDD

SEQ ID NO: 1590 - protein, 28 aa, Artificial Sequence
  Description of Artificial Sequence: Synthetic peptide
  C-terminus amidated
LSTAADLQGVVTDTVASGLDKDYLKPDD

SEQ ID NO: 1591 - protein, 28 aa, Artificial Sequence
  Description of Artificial Sequence: Synthetic peptide
  N-terminus acetylated
  C-terminus amidated
LSTAADLQGVVTDTVASGLDKDYLKPDD

SEQ ID NO: 1592 - protein, 28 aa, Artificial Sequence
  Description of Artificial Sequence: Synthetic peptide
  C-terminus amidated
LSWAADLQGVVTDTVASGLDKDYLKPDD

SEQ ID NO: 1593 - protein, 28 aa, Artificial Sequence
  Description of Artificial Sequence: Synthetic peptide
  N-terminus acetylated
  C-terminus amidated
LSWAADLQGVVTDTVASGLDKDYLKPDD

SEQ ID NO: 1594 - protein, 28 aa, Artificial Sequence
  Description of Artificial Sequence: Synthetic peptide
  C-terminus amidated
LSTAADVQGVVTDTVASGLDKDYLKPDD

SEQ ID NO: 1595 - protein, 28 aa, Artificial Sequence
  Description of Artificial Sequence: Synthetic peptide
  N-terminus acetylated
  C-terminus amidated
LSTAADVQGVVTDTVASGLDKDYLKPDD

SEQ ID NO: 1596 - protein, 28 aa, Artificial Sequence
  Description of Artificial Sequence: Synthetic peptide
  C-terminus amidated
LSWAADVQGVVTDTVASGLDKDYLKPDD

SEQ ID NO: 1597 - protein, 28 aa, Artificial Sequence
  Description of Artificial Sequence: Synthetic peptide
  N-terminus acetylated
  C-terminus amidated
LSWAADVQGVVTDTVASGLDKDYLKPDD

SEQ ID NO: 1598 - protein, 28 aa, Artificial Sequence
  Description of Artificial Sequence: Synthetic peptide
  C-terminus amidated
LSTAADMWGVVTDTVASGLDKDYLKPDD

SEQ ID NO: 1599 - protein, 28 aa, Artificial Sequence
  Description of Artificial Sequence: Synthetic peptide
  N-terminus acetylated
  C-terminus amidated
LSTAADMWGVVTDTVASGLDKDYLKPDD

SEQ ID NO: 1600 - protein, 28 aa, Artificial Sequence
  Description of Artificial Sequence: Synthetic peptide
  C-terminus amidated
LSWAADMWGVVTDTVASGLDKDYLKPDD

SEQ ID NO: 1601 - protein, 28 aa, Artificial Sequence
  Description of Artificial Sequence: Synthetic peptide
  N-terminus acetylated
  C-terminus amidated
LSWAADMWGVVTDTVASGLDKDYLKPDD

SEQ ID NO: 1602 - protein, 28 aa, Artificial Sequence
  Description of Artificial Sequence: Synthetic peptide
  C-terminus amidated
LSTAADLWGVVTDTVASGLDKDYLKPDD

SEQ ID NO: 1603 - protein, 28 aa, Artificial Sequence
  Description of Artificial Sequence: Synthetic peptide
  N-terminus acetylated
  C-terminus amidated
LSTAADLWGVVTDTVASGLDKDYLKPDD

SEQ ID NO: 1604 - protein, 28 aa, Artificial Sequence
  Description of Artificial Sequence: Synthetic peptide
  C-terminus amidated
LSWAADLWGVVTDTVASGLDKDYLKPDD

SEQ ID NO: 1605 - protein, 28 aa, Artificial Sequence
  Description of Artificial Sequence: Synthetic peptide
  N-terminus acetylated
  C-terminus amidated
LSWAADLWGVVTDTVASGLDKDYLKPDD

SEQ ID NO: 1606 - protein, 28 aa, Artificial Sequence
  Description of Artificial Sequence: Synthetic peptide
  C-terminus amidated
LSTAADVWGVVTDTVASGLDKDYLKPDD

SEQ ID NO: 1607 - protein, 28 aa, Artificial Sequence
  Description of Artificial Sequence: Synthetic peptide
  N-terminus acetylated
  C-terminus amidated
LSTAADVWGVVTDTVASGLDKDYLKPDD

SEQ ID NO: 1608 - protein, 28 aa, Artificial Sequence
  Description of Artificial Sequence: Synthetic peptide
  C-terminus amidated
LSWAADVWGVVTDTVASGLDKDYLKPDD

SEQ ID NO: 1609 - protein, 28 aa, Artificial Sequence
  Description of Artificial Sequence: Synthetic peptide
  N-terminus acetylated
  C-terminus amidated
LSWAADVWGVVTDTVASGLDKDYLKPDD

SEQ ID NO: 1610 - protein, 28 aa, Artificial Sequence
  Description of Artificial Sequence: Synthetic peptide
  C-terminus amidated
LSTAADMQAVVTDTVASGLDKDYLKPDD

SEQ ID NO: 1611 - protein, 28 aa, Artificial Sequence
  Description of Artificial Sequence: Synthetic peptide
  N-terminus acetylated
  C-terminus amidated
LSTAADMQAVVTDTVASGLDKDYLKPDD

SEQ ID NO: 1612 - protein, 28 aa, Artificial Sequence
  Description of Artificial Sequence: Synthetic peptide
  C-terminus amidated
LSWAADMQAVVTDTVASGLDKDYLKPDD

SEQ ID NO: 1613 - protein, 28 aa, Artificial Sequence
  Description of Artificial Sequence: Synthetic peptide
  N-terminus acetylated
  C-terminus amidated
LSWAADMQAVVTDTVASGLDKDYLKPDD

SEQ ID NO: 1614 - protein, 28 aa, Artificial Sequence
  Description of Artificial Sequence: Synthetic peptide
  C-terminus amidated
LSTAADLQAVVTDTVASGLDKDYLKPDD

SEQ ID NO: 1615 - protein, 28 aa, Artificial Sequence
  Description of Artificial Sequence: Synthetic peptide
  N-terminus acetylated
  C-terminus amidated
LSTAADLQAVVTDTVASGLDKDYLKPDD

SEQ ID NO: 1616 - protein, 28 aa, Artificial Sequence
  Description of Artificial Sequence: Synthetic peptide
  C-terminus amidated
LSWAADLQAVVTDTVASGLDKDYLKPDD

SEQ ID NO: 1617 - protein, 28 aa, Artificial Sequence
  Description of Artificial Sequence: Synthetic peptide
  N-terminus acetylated
  C-terminus amidated
LSWAADLQAVVTDTVASGLDKDYLKPDD

SEQ ID NO: 1618 - protein, 28 aa, Artificial Sequence
  Description of Artificial Sequence: Synthetic peptide
  C-terminus amidated
LSTAADVQAVVTDTVASGLDKDYLKPDD

SEQ ID NO: 1619 - protein, 28 aa, Artificial Sequence
  Description of Artificial Sequence: Synthetic peptide
  N-terminus acetylated
  C-terminus amidated
LSTAADVQAVVTDTVASGLDKDYLKPDD

SEQ ID NO: 1620 - protein, 28 aa, Artificial Sequence
  Description of Artificial Sequence: Synthetic peptide
  C-terminus amidated
LSWAADVQAVVTDTVASGLDKDYLKPDD

SEQ ID NO: 1621 - protein, 28 aa, Artificial Sequence
  Description of Artificial Sequence: Synthetic peptide
  N-terminus acetylated
  C-terminus amidated
LSWAADVQAVVTDTVASGLDKDYLKPDD

SEQ ID NO: 1622 - protein, 28 aa, Artificial Sequence
  Description of Artificial Sequence: Synthetic peptide
  C-terminus amidated
LSTAADMWAVVTDTVASGLDKDYLKPDD

SEQ ID NO: 1623 - protein, 28 aa, Artificial Sequence
  Description of Artificial Sequence: Synthetic peptide
  N-terminus acetylated
  C-terminus amidated
LSTAADMWAVVTDTVASGLDKDYLKPDD

SEQ ID NO: 1624 - protein, 28 aa, Artificial Sequence
  Description of Artificial Sequence: Synthetic peptide
  C-terminus amidated
LSWAADMWAVVTDTVASGLDKDYLKPDD

SEQ ID NO: 1625 - protein, 28 aa, Artificial Sequence
  Description of Artificial Sequence: Synthetic peptide
  N-terminus acetylated
  C-terminus amidated
LSWAADMWAVVTDTVASGLDKDYLKPDD

SEQ ID NO: 1626 - protein, 28 aa, Artificial Sequence
  Description of Artificial Sequence: Synthetic peptide
  C-terminus amidated
LSTAADLWAVVTDTVASGLDKDYLKPDD

SEQ ID NO: 1627 - protein, 28 aa, Artificial Sequence
  Description of Artificial Sequence: Synthetic peptide
  N-terminus acetylated
  C-terminus amidated
LSTAADLWAVVTDTVASGLDKDYLKPDD

SEQ ID NO: 1628 - protein, 28 aa, Artificial Sequence
  Description of Artificial Sequence: Synthetic peptide
  C-terminus amidated
LSWAADLWAVVTDTVASGLDKDYLKPDD

SEQ ID NO: 1629 - protein, 28 aa, Artificial Sequence
  Description of Artificial Sequence: Synthetic peptide
  N-terminus acetylated
  C-terminus amidated
LSWAADLWAVVTDTVASGLDKDYLKPDD

SEQ ID NO: 1630 - protein, 28 aa, Artificial Sequence
  Description of Artificial Sequence: Synthetic peptide
  C-terminus amidated
LSTAADVWAVVTDTVASGLDKDYLKPDD

SEQ ID NO: 1631 - protein, 28 aa, Artificial Sequence
  Description of Artificial Sequence: Synthetic peptide
  N-terminus acetylated
  C-terminus amidated
LSTAADVWAVVTDTVASGLDKDYLKPDD

SEQ ID NO: 1632 - protein, 28 aa, Artificial Sequence
  Description of Artificial Sequence: Synthetic peptide
  C-terminus amidated
LSWAADVWAVVTDTVASGLDKDYLKPDD

SEQ ID NO: 1633 - protein, 28 aa, Artificial Sequence
  Description of Artificial Sequence: Synthetic peptide
  N-terminus acetylated
  C-terminus amidated
LSWAADVWAVVTDTVASGLDKDYLKPDD

SEQ ID NO: 1634 - protein, 28 aa, Artificial Sequence
  Description of Artificial Sequence: Synthetic peptide
  C-terminus amidated
LSTAADMQGVVWDTVASGLDKDYLKPDD

SEQ ID NO: 1635 - protein, 28 aa, Artificial Sequence
  Description of Artificial Sequence: Synthetic peptide
  N-terminus acetylated
  C-terminus amidated
LSTAADMQGVVWDTVASGLDKDYLKPDD

SEQ ID NO: 1636 - protein, 28 aa, Artificial Sequence
  Description of Artificial Sequence: Synthetic peptide
  C-terminus amidated
LSWAADMQGVVWDTVASGLDKDYLKPDD

SEQ ID NO: 1637 - protein, 28 aa, Artificial Sequence
  Description of Artificial Sequence: Synthetic peptide
  N-terminus acetylated
  C-terminus amidated
LSWAADMQGVVWDTVASGLDKDYLKPDD

SEQ ID NO: 1638 - protein, 28 aa, Artificial Sequence
  Description of Artificial Sequence: Synthetic peptide
  C-terminus amidated
LSTAADLQGVVWDTVASGLDKDYLKPDD

SEQ ID NO: 1639 - protein, 28 aa, Artificial Sequence
  Description of Artificial Sequence: Synthetic peptide
  N-terminus acetylated
  C-terminus amidated
LSTAADLQGVVWDTVASGLDKDYLKPDD

SEQ ID NO: 1640 - protein, 28 aa, Artificial Sequence
  Description of Artificial Sequence: Synthetic peptide
  C-terminus amidated
LSWAADLQGVVWDTVASGLDKDYLKPDD

SEQ ID NO: 1641 - protein, 28 aa, Artificial Sequence
  Description of Artificial Sequence: Synthetic peptide
  N-terminus acetylated
  C-terminus amidated
LSWAADLQGVVWDTVASGLDKDYLKPDD

SEQ ID NO: 1642 - protein, 28 aa, Artificial Sequence
  Description of Artificial Sequence: Synthetic peptide
  C-terminus amidated
LSTAADVQGVVWDTVASGLDKDYLKPDD

SEQ ID NO: 1643 - protein, 28 aa, Artificial Sequence
  Description of Artificial Sequence: Synthetic peptide
  N-terminus acetylated
  C-terminus amidated
LSTAADVQGVVWDTVASGLDKDYLKPDD

SEQ ID NO: 1644 - protein, 28 aa, Artificial Sequence
  Description of Artificial Sequence: Synthetic peptide
  C-terminus amidated
LSWAADVQGVVWDTVASGLDKDYLKPDD

SEQ ID NO: 1645 - protein, 28 aa, Artificial Sequence
  Description of Artificial Sequence: Synthetic peptide
  N-terminus acetylated
  C-terminus amidated
LSWAADVQGVVWDTVASGLDKDYLKPDD

SEQ ID NO: 1646 - protein, 28 aa, Artificial Sequence
  Description of Artificial Sequence: Synthetic peptide
  C-terminus amidated
LSTAADMWGVVWDTVASGLDKDYLKPDD

SEQ ID NO: 1647 - protein, 28 aa, Artificial Sequence
  Description of Artificial Sequence: Synthetic peptide
  N-terminus acetylated
  C-terminus amidated
LSTAADMWGVVWDTVASGLDKDYLKPDD

SEQ ID NO: 1648 - protein, 28 aa, Artificial Sequence
  Description of Artificial Sequence: Synthetic peptide
  C-terminus amidated
LSWAADMWGVVWDTVASGLDKDYLKPDD

SEQ ID NO: 1649 - protein, 28 aa, Artificial Sequence
  Description of Artificial Sequence: Synthetic peptide
  N-terminus acetylated
  C-terminus amidated
LSWAADMWGVVWDTVASGLDKDYLKPDD

SEQ ID NO: 1650 - protein, 28 aa, Artificial Sequence
  Description of Artificial Sequence: Synthetic peptide
  C-terminus amidated
LSTAADLWGVVWDTVASGLDKDYLKPDD

SEQ ID NO: 1651 - protein, 28 aa, Artificial Sequence
  Description of Artificial Sequence: Synthetic peptide
  N-terminus acetylated
  C-terminus amidated
LSTAADLWGVVWDTVASGLDKDYLKPDD

SEQ ID NO: 1652 - protein, 28 aa, Artificial Sequence
  Description of Artificial Sequence: Synthetic peptide
  C-terminus amidated
LSWAADLWGVVWDTVASGLDKDYLKPDD

SEQ ID NO: 1653 - protein, 28 aa, Artificial Sequence
  Description of Artificial Sequence: Synthetic peptide
  N-terminus acetylated
  C-terminus amidated
LSWAADLWGVVWDTVASGLDKDYLKPDD

SEQ ID NO: 1654 - protein, 28 aa, Artificial Sequence
  Description of Artificial Sequence: Synthetic peptide
  C-terminus amidated
LSTAADVWGVVWDTVASGLDKDYLKPDD

SEQ ID NO: 1655 - protein, 28 aa, Artificial Sequence
  Description of Artificial Sequence: Synthetic peptide
  N-terminus acetylated
  C-terminus amidated
LSTAADVWGVVWDTVASGLDKDYLKPDD

SEQ ID NO: 1656 - protein, 28 aa, Artificial Sequence
  Description of Artificial Sequence: Synthetic peptide
  C-terminus amidated
LSWAADVWGVVWDTVASGLDKDYLKPDD

SEQ ID NO: 1657 - protein, 28 aa, Artificial Sequence
  Description of Artificial Sequence: Synthetic peptide
  N-terminus acetylated
  C-terminus amidated
LSWAADVWGVVWDTVASGLDKDYLKPDD

SEQ ID NO: 1658 - protein, 28 aa, Artificial Sequence
  Description of Artificial Sequence: Synthetic peptide
  C-terminus amidated
LSTAADMQAVVWDTVASGLDKDYLKPDD

SEQ ID NO: 1659 - protein, 28 aa, Artificial Sequence
  Description of Artificial Sequence: Synthetic peptide
  N-terminus acetylated
  C-terminus amidated
LSTAADMQAVVWDTVASGLDKDYLKPDD

SEQ ID NO: 1660 - protein, 28 aa, Artificial Sequence
  Description of Artificial Sequence: Synthetic peptide
  C-terminus amidated
LSWAADMQAVVWDTVASGLDKDYLKPDD

SEQ ID NO: 1661 - protein, 28 aa, Artificial Sequence
  Description of Artificial Sequence: Synthetic peptide
  N-terminus acetylated
  C-terminus amidated
LSWAADMQAVVWDTVASGLDKDYLKPDD

SEQ ID NO: 1662 - protein, 28 aa, Artificial Sequence
  Description of Artificial Sequence: Synthetic peptide
  C-terminus amidated
LSTAADLQAVVWDTVASGLDKDYLKPDD

SEQ ID NO: 1663 - protein, 28 aa, Artificial Sequence
  Description of Artificial Sequence: Synthetic peptide
  N-terminus acetylated
  C-terminus amidated
LSTAADLQAVVWDTVASGLDKDYLKPDD

SEQ ID NO: 1664 - protein, 28 aa, Artificial Sequence
  Description of Artificial Sequence: Synthetic peptide
  C-terminus amidated
LSWAADLQAVVWDTVASGLDKDYLKPDD

SEQ ID NO: 1665 - protein, 28 aa, Artificial Sequence
  Description of Artificial Sequence: Synthetic peptide
  N-terminus acetylated
  C-terminus amidated
LSWAADLQAVVWDTVASGLDKDYLKPDD

SEQ ID NO: 1666 - protein, 28 aa, Artificial Sequence
  Description of Artificial Sequence: Synthetic peptide
  C-terminus amidated
LSTAADVQAVVWDTVASGLDKDYLKPDD

SEQ ID NO: 1667 - protein, 28 aa, Artificial Sequence
  Description of Artificial Sequence: Synthetic peptide
  N-terminus acetylated
  C-terminus amidated
LSTAADVQAVVWDTVASGLDKDYLKPDD

SEQ ID NO: 1668 - protein, 28 aa, Artificial Sequence
  Description of Artificial Sequence: Synthetic peptide
  C-terminus amidated
LSWAADVQAVVWDTVASGLDKDYLKPDD

SEQ ID NO: 1669 - protein, 28 aa, Artificial Sequence
  Description of Artificial Sequence: Synthetic peptide
  N-terminus acetylated
  C-terminus amidated
LSWAADVQAVVWDTVASGLDKDYLKPDD

SEQ ID NO: 1670 - protein, 28 aa, Artificial Sequence
  Description of Artificial Sequence: Synthetic peptide
  C-terminus amidated
LSTAADMWAVVWDTVASGLDKDYLKPDD

SEQ ID NO: 1671 - protein, 28 aa, Artificial Sequence
  Description of Artificial Sequence: Synthetic peptide
  N-terminus acetylated
  C-terminus amidated
LSTAADMWAVVWDTVASGLDKDYLKPDD

SEQ ID NO: 1672 - protein, 28 aa, Artificial Sequence
  Description of Artificial Sequence: Synthetic peptide
  C-terminus amidated
LSWAADMWAVVWDTVASGLDKDYLKPDD

SEQ ID NO: 1673 - protein, 28 aa, Artificial Sequence
  Description of Artificial Sequence: Synthetic peptide
  N-terminus acetylated
  C-terminus amidated
LSWAADMWAVVWDTVASGLDKDYLKPDD

SEQ ID NO: 1674 - protein, 28 aa, Artificial Sequence
  Description of Artificial Sequence: Synthetic peptide
  C-terminus amidated
LSTAADLWAVVWDTVASGLDKDYLKPDD

SEQ ID NO: 1675 - protein, 28 aa, Artificial Sequence
  Description of Artificial Sequence: Synthetic peptide
  N-terminus acetylated
  C-terminus amidated
LSTAADLWAVVWDTVASGLDKDYLKPDD

SEQ ID NO: 1676 - protein, 28 aa, Artificial Sequence
  Description of Artificial Sequence: Synthetic peptide
  C-terminus amidated
LSWAADLWAVVWDTVASGLDKDYLKPDD

SEQ ID NO: 1677 - protein, 28 aa, Artificial Sequence
  Description of Artificial Sequence: Synthetic peptide
  N-terminus acetylated
  C-terminus amidated
LSWAADLWAVVWDTVASGLDKDYLKPDD

SEQ ID NO: 1678 - protein, 28 aa, Artificial Sequence
  Description of Artificial Sequence: Synthetic peptide
  C-terminus amidated
LSTAADVWAVVWDTVASGLDKDYLKPDD

SEQ ID NO: 1679 - protein, 28 aa, Artificial Sequence
  Description of Artificial Sequence: Synthetic peptide
  N-terminus acetylated
  C-terminus amidated
LSTAADVWAVVWDTVASGLDKDYLKPDD

SEQ ID NO: 1680 - protein, 28 aa, Artificial Sequence
  Description of Artificial Sequence: Synthetic peptide
  C-terminus amidated
LSWAADVWAVVWDTVASGLDKDYLKPDD

SEQ ID NO: 1681 - protein, 28 aa, Artificial Sequence
  Description of Artificial Sequence: Synthetic peptide
  N-terminus acetylated
  C-terminus amidated
LSWAADVWAVVWDTVASGLDKDYLKPDD

SEQ ID NO: 1682 - protein, 28 aa, Artificial Sequence
  Description of Artificial Sequence: Synthetic peptide
  C-terminus amidated
LSTAADMQGVVTDWVASGLDKDYLKPDD

SEQ ID NO: 1683 - protein, 28 aa, Artificial Sequence
  Description of Artificial Sequence: Synthetic peptide
  N-terminus acetylated
  C-terminus amidated
LSTAADMQGVVTDWVASGLDKDYLKPDD

SEQ ID NO: 1684 - protein, 28 aa, Artificial Sequence
  Description of Artificial Sequence: Synthetic peptide
  C-terminus amidated
LSWAADMQGVVTDWVASGLDKDYLKPDD

SEQ ID NO: 1685 - protein, 28 aa, Artificial Sequence
  Description of Artificial Sequence: Synthetic peptide
  N-terminus acetylated
  C-terminus amidated
LSWAADMQGVVTDWVASGLDKDYLKPDD

SEQ ID NO: 1686 - protein, 28 aa, Artificial Sequence
  Description of Artificial Sequence: Synthetic peptide
  C-terminus amidated
LSTAADLQGVVTDWVASGLDKDYLKPDD

SEQ ID NO: 1687 - protein, 28 aa, Artificial Sequence
  Description of Artificial Sequence: Synthetic peptide
  N-terminus acetylated
  C-terminus amidated
LSTAADLQGVVTDWVASGLDKDYLKPDD

SEQ ID NO: 1688 - protein, 28 aa, Artificial Sequence
  Description of Artificial Sequence: Synthetic peptide
  C-terminus amidated
LSWAADLQGVVTDWVASGLDKDYLKPDD

SEQ ID NO: 1689 - protein, 28 aa, Artificial Sequence
  Description of Artificial Sequence: Synthetic peptide
  N-terminus acetylated
  C-terminus amidated
LSWAADLQGVVTDWVASGLDKDYLKPDD

SEQ ID NO: 1690 - protein, 28 aa, Artificial Sequence
  Description of Artificial Sequence: Synthetic peptide
  C-terminus amidated
LSTAADVQGVVTDWVASGLDKDYLKPDD

SEQ ID NO: 1691 - protein, 28 aa, Artificial Sequence
  Description of Artificial Sequence: Synthetic peptide
  N-terminus acetylated
  C-terminus amidated
LSTAADVQGVVTDWVASGLDKDYLKPDD

SEQ ID NO: 1692 - protein, 28 aa, Artificial Sequence
  Description of Artificial Sequence: Synthetic peptide
  C-terminus amidated
LSWAADVQGVVTDWVASGLDKDYLKPDD

SEQ ID NO: 1693 - protein, 28 aa, Artificial Sequence
  Description of Artificial Sequence: Synthetic peptide
  N-terminus acetylated
  C-terminus amidated
LSWAADVQGVVTDWVASGLDKDYLKPDD

SEQ ID NO: 1694 - protein, 28 aa, Artificial Sequence
  Description of Artificial Sequence: Synthetic peptide
  C-terminus amidated
LSTAADMWGVVTDWVASGLDKDYLKPDD

SEQ ID NO: 1695 - protein, 28 aa, Artificial Sequence
  Description of Artificial Sequence: Synthetic peptide
  N-terminus acetylated
  C-terminus amidated
LSTAADMWGVVTDWVASGLDKDYLKPDD

SEQ ID NO: 1696 - protein, 28 aa, Artificial Sequence
  Description of Artificial Sequence: Synthetic peptide
  C-terminus amidated
LSWAADMWGVVTDWVASGLDKDYLKPDD

SEQ ID NO: 1697 - protein, 28 aa, Artificial Sequence
  Description of Artificial Sequence: Synthetic peptide
  N-terminus acetylated
  C-terminus amidated
LSWAADMWGVVTDWVASGLDKDYLKPDD

SEQ ID NO: 1698 - protein, 28 aa, Artificial Sequence
  Description of Artificial Sequence: Synthetic peptide
  C-terminus amidated
LSTAADLWGVVTDWVASGLDKDYLKPDD

SEQ ID NO: 1699 - protein, 28 aa, Artificial Sequence
  Description of Artificial Sequence: Synthetic peptide
  N-terminus acetylated
  C-terminus amidated
LSTAADLWGVVTDWVASGLDKDYLKPDD

SEQ ID NO: 1700 - protein, 28 aa, Artificial Sequence
  Description of Artificial Sequence: Synthetic peptide
  C-terminus amidated
LSWAADLWGVVTDWVASGLDKDYLKPDD

SEQ ID NO: 1701 - protein, 28 aa, Artificial Sequence
  Description of Artificial Sequence: Synthetic peptide
  N-terminus acetylated
  C-terminus amidated
LSWAADLWGVVTDWVASGLDKDYLKPDD

SEQ ID NO: 1702 - protein, 28 aa, Artificial Sequence
  Description of Artificial Sequence: Synthetic peptide
  C-terminus amidated
LSTAADVWGVVTDWVASGLDKDYLKPDD

SEQ ID NO: 1703 - protein, 28 aa, Artificial Sequence
  Description of Artificial Sequence: Synthetic peptide
  N-terminus acetylated
  C-terminus amidated
LSTAADVWGVVTDWVASGLDKDYLKPDD

SEQ ID NO: 1704 - protein, 28 aa, Artificial Sequence
  Description of Artificial Sequence: Synthetic peptide
  C-terminus amidated
LSWAADVWGVVTDWVASGLDKDYLKPDD

SEQ ID NO: 1705 - protein, 28 aa, Artificial Sequence
  Description of Artificial Sequence: Synthetic peptide
  N-terminus acetylated
  C-terminus amidated
LSWAADVWGVVTDWVASGLDKDYLKPDD

SEQ ID NO: 1706 - protein, 28 aa, Artificial Sequence
  Description of Artificial Sequence: Synthetic peptide
  C-terminus amidated
LSTAADMQAVVTDWVASGLDKDYLKPDD

SEQ ID NO: 1707 - protein, 28 aa, Artificial Sequence
  Description of Artificial Sequence: Synthetic peptide
  N-terminus acetylated
  C-terminus amidated
LSTAADMQAVVTDWVASGLDKDYLKPDD

SEQ ID NO: 1708 - protein, 28 aa, Artificial Sequence
  Description of Artificial Sequence: Synthetic peptide
  C-terminus amidated
LSWAADMQAVVTDWVASGLDKDYLKPDD

SEQ ID NO: 1709 - protein, 28 aa, Artificial Sequence
  Description of Artificial Sequence: Synthetic peptide
  N-terminus acetylated
  C-terminus amidated
LSWAADMQAVVTDWVASGLDKDYLKPDD

SEQ ID NO: 1710 - protein, 28 aa, Artificial Sequence
  Description of Artificial Sequence: Synthetic peptide
  C-terminus amidated
LSTAADLQAVVTDWVASGLDKDYLKPDD

SEQ ID NO: 1711 - protein, 28 aa, Artificial Sequence
  Description of Artificial Sequence: Synthetic peptide
  N-terminus acetylated
  C-terminus amidated
LSTAADLQAVVTDWVASGLDKDYLKPDD

SEQ ID NO: 1712 - protein, 28 aa, Artificial Sequence
  Description of Artificial Sequence: Synthetic peptide
  C-terminus amidated
LSWAADLQAVVTDWVASGLDKDYLKPDD

SEQ ID NO: 1713 - protein, 28 aa, Artificial Sequence
  Description of Artificial Sequence: Synthetic peptide
  N-terminus acetylated
  C-terminus amidated
LSWAADLQAVVTDWVASGLDKDYLKPDD

SEQ ID NO: 1714 - protein, 28 aa, Artificial Sequence
  Description of Artificial Sequence: Synthetic peptide
  C-terminus amidated
LSTAADVQAVVTDWVASGLDKDYLKPDD

SEQ ID NO: 1715 - protein, 28 aa, Artificial Sequence
  Description of Artificial Sequence: Synthetic peptide
  N-terminus acetylated
  C-terminus amidated
LSTAADVQAVVTDWVASGLDKDYLKPDD

SEQ ID NO: 1716 - protein, 28 aa, Artificial Sequence
  Description of Artificial Sequence: Synthetic peptide
  C-terminus amidated
LSWAADVQAVVTDWVASGLDKDYLKPDD

SEQ ID NO: 1717 - protein, 28 aa, Artificial Sequence
  Description of Artificial Sequence: Synthetic peptide
  N-terminus acetylated
  C-terminus amidated
LSWAADVQAVVTDWVASGLDKDYLKPDD

SEQ ID NO: 1718 - protein, 28 aa, Artificial Sequence
  Description of Artificial Sequence: Synthetic peptide
  C-terminus amidated
LSTAADMWAVVTDWVASGLDKDYLKPDD

SEQ ID NO: 1719 - protein, 28 aa, Artificial Sequence
  Description of Artificial Sequence: Synthetic peptide
  N-terminus acetylated
  C-terminus amidated
LSTAADMWAVVTDWVASGLDKDYLKPDD

SEQ ID NO: 1720 - protein, 28 aa, Artificial Sequence
  Description of Artificial Sequence: Synthetic peptide
  C-terminus amidated
LSWAADMWAVVTDWVASGLDKDYLKPDD

SEQ ID NO: 1721 - protein, 28 aa, Artificial Sequence
  Description of Artificial Sequence: Synthetic peptide
  N-terminus acetylated
  C-terminus amidated
LSWAADMWAVVTDWVASGLDKDYLKPDD

SEQ ID NO: 1722 - protein, 28 aa, Artificial Sequence
  Description of Artificial Sequence: Synthetic peptide
  C-terminus amidated
LSTAADLWAVVTDWVASGLDKDYLKPDD

SEQ ID NO: 1723 - protein, 28 aa, Artificial Sequence
  Description of Artificial Sequence: Synthetic peptide
  N-terminus acetylated
  C-terminus amidated
LSTAADLWAVVTDWVASGLDKDYLKPDD

SEQ ID NO: 1724 - protein, 28 aa, Artificial Sequence
  Description of Artificial Sequence: Synthetic peptide
  C-terminus amidated
LSWAADLWAVVTDWVASGLDKDYLKPDD

SEQ ID NO: 1725 - protein, 28 aa, Artificial Sequence
  Description of Artificial Sequence: Synthetic peptide
  N-terminus acetylated
  C-terminus amidated
LSWAADLWAVVTDWVASGLDKDYLKPDD

SEQ ID NO: 1726 - protein, 28 aa, Artificial Sequence
  Description of Artificial Sequence: Synthetic peptide
  C-terminus amidated
LSTAADVWAVVTDWVASGLDKDYLKPDD

SEQ ID NO: 1727 - protein, 28 aa, Artificial Sequence
  Description of Artificial Sequence: Synthetic peptide
  N-terminus acetylated
  C-terminus amidated
LSTAADVWAVVTDWVASGLDKDYLKPDD

SEQ ID NO: 1728 - protein, 28 aa, Artificial Sequence
  Description of Artificial Sequence: Synthetic peptide
  C-terminus amidated
LSWAADVWAVVTDWVASGLDKDYLKPDD

SEQ ID NO: 1729 - protein, 28 aa, Artificial Sequence
  Description of Artificial Sequence: Synthetic peptide
  N-terminus acetylated
  C-terminus amidated
LSWAADVWAVVTDWVASGLDKDYLKPDD

SEQ ID NO: 1730 - protein, 28 aa, Artificial Sequence
  Description of Artificial Sequence: Synthetic peptide
  C-terminus amidated
LSTAADMQGVVWDWVASGLDKDYLKPDD

SEQ ID NO: 1731 - protein, 28 aa, Artificial Sequence
  Description of Artificial Sequence: Synthetic peptide
  N-terminus acetylated
  C-terminus amidated
LSTAADMQGVVWDWVASGLDKDYLKPDD

SEQ ID NO: 1732 - protein, 28 aa, Artificial Sequence
  Description of Artificial Sequence: Synthetic peptide
  C-terminus amidated
LSWAADMQGVVWDWVASGLDKDYLKPDD

SEQ ID NO: 1733 - protein, 28 aa, Artificial Sequence
  Description of Artificial Sequence: Synthetic peptide
  N-terminus acetylated
  C-terminus amidated
LSWAADMQGVVWDWVASGLDKDYLKPDD

SEQ ID NO: 1734 - protein, 28 aa, Artificial Sequence
  Description of Artificial Sequence: Synthetic peptide
  C-terminus amidated
LSTAADLQGVVWDWVASGLDKDYLKPDD

SEQ ID NO: 1735 - protein, 28 aa, Artificial Sequence
  Description of Artificial Sequence: Synthetic peptide
  N-terminus acetylated
  C-terminus amidated
LSTAADLQGVVWDWVASGLDKDYLKPDD

SEQ ID NO: 1736 - protein, 28 aa, Artificial Sequence
  Description of Artificial Sequence: Synthetic peptide
  C-terminus amidated
LSWAADLQGVVWDWVASGLDKDYLKPDD

SEQ ID NO: 1737 - protein, 28 aa, Artificial Sequence
  Description of Artificial Sequence: Synthetic peptide
  N-terminus acetylated
  C-terminus amidated
LSWAADLQGVVWDWVASGLDKDYLKPDD

SEQ ID NO: 1738 - protein, 28 aa, Artificial Sequence
  Description of Artificial Sequence: Synthetic peptide
  C-terminus amidated
LSTAADVQGVVWDWVASGLDKDYLKPDD

SEQ ID NO: 1739 - protein, 28 aa, Artificial Sequence
  Description of Artificial Sequence: Synthetic peptide
  N-terminus acetylated
  C-terminus amidated
LSTAADVQGVVWDWVASGLDKDYLKPDD

SEQ ID NO: 1740 - protein, 28 aa, Artificial Sequence
  Description of Artificial Sequence: Synthetic peptide
  C-terminus amidated
LSWAADVQGVVWDWVASGLDKDYLKPDD

SEQ ID NO: 1741 - protein, 28 aa, Artificial Sequence
  Description of Artificial Sequence: Synthetic peptide
  N-terminus acetylated
  C-terminus amidated
LSWAADVQGVVWDWVASGLDKDYLKPDD

SEQ ID NO: 1742 - protein, 28 aa, Artificial Sequence
  Description of Artificial Sequence: Synthetic peptide
  C-terminus amidated
LSTAADMWGVVWDWVASGLDKDYLKPDD

SEQ ID NO: 1743 - protein, 28 aa, Artificial Sequence
  Description of Artificial Sequence: Synthetic peptide
  N-terminus acetylated
  C-terminus amidated
LSTAADMWGVVWDWVASGLDKDYLKPDD

SEQ ID NO: 1744 - protein, 28 aa, Artificial Sequence
  Description of Artificial Sequence: Synthetic peptide
  C-terminus amidated
LSWAADMWGVVWDWVASGLDKDYLKPDD

SEQ ID NO: 1745 - protein, 28 aa, Artificial Sequence
  Description of Artificial Sequence: Synthetic peptide
  N-terminus acetylated
  C-terminus amidated
LSWAADMWGVVWDWVASGLDKDYLKPDD

SEQ ID NO: 1746 - protein, 28 aa, Artificial Sequence
  Description of Artificial Sequence: Synthetic peptide
  C-terminus amidated
LSTAADLWGVVWDWVASGLDKDYLKPDD

SEQ ID NO: 1747 - protein, 28 aa, Artificial Sequence
  Description of Artificial Sequence: Synthetic peptide
  N-terminus acetylated
  C-terminus amidated
LSTAADLWGVVWDWVASGLDKDYLKPDD

SEQ ID NO: 1748 - protein, 28 aa, Artificial Sequence
  Description of Artificial Sequence: Synthetic peptide
  C-terminus amidated
LSWAADLWGVVWDWVASGLDKDYLKPDD

SEQ ID NO: 1749 - protein, 28 aa, Artificial Sequence
  Description of Artificial Sequence: Synthetic peptide
  N-terminus acetylated
  C-terminus amidated
LSWAADLWGVVWDWVASGLDKDYLKPDD

SEQ ID NO: 1750 - protein, 28 aa, Artificial Sequence
  Description of Artificial Sequence: Synthetic peptide
  C-terminus amidated
LSTAADVWGVVWDWVASGLDKDYLKPDD

SEQ ID NO: 1751 - protein, 28 aa, Artificial Sequence
  Description of Artificial Sequence: Synthetic peptide
  N-terminus acetylated
  C-terminus amidated
LSTAADVWGVVWDWVASGLDKDYLKPDD

SEQ ID NO: 1752 - protein, 28 aa, Artificial Sequence
  Description of Artificial Sequence: Synthetic peptide
  C-terminus amidated
LSWAADVWGVVWDWVASGLDKDYLKPDD

SEQ ID NO: 1753 - protein, 28 aa, Artificial Sequence
  Description of Artificial Sequence: Synthetic peptide
  N-terminus acetylated
  C-terminus amidated
LSWAADVWGVVWDWVASGLDKDYLKPDD

SEQ ID NO: 1754 - protein, 28 aa, Artificial Sequence
  Description of Artificial Sequence: Synthetic peptide
  C-terminus amidated
LSTAADMQAVVWDWVASGLDKDYLKPDD

SEQ ID NO: 1755 - protein, 28 aa, Artificial Sequence
  Description of Artificial Sequence: Synthetic peptide
  N-terminus acetylated
  C-terminus amidated
LSTAADMQAVVWDWVASGLDKDYLKPDD

SEQ ID NO: 1756 - protein, 28 aa, Artificial Sequence
  Description of Artificial Sequence: Synthetic peptide
  C-terminus amidated
LSWAADMQAVVWDWVASGLDKDYLKPDD

SEQ ID NO: 1757 - protein, 28 aa, Artificial Sequence
  Description of Artificial Sequence: Synthetic peptide
  N-terminus acetylated
  C-terminus amidated
LSWAADMQAVVWDWVASGLDKDYLKPDD

SEQ ID NO: 1758 - protein, 28 aa, Artificial Sequence
  Description of Artificial Sequence: Synthetic peptide
  C-terminus amidated
LSTAADLQAVVWDWVASGLDKDYLKPDD

SEQ ID NO: 1759 - protein, 28 aa, Artificial Sequence
  Description of Artificial Sequence: Synthetic peptide
  N-terminus acetylated
  C-terminus amidated
LSTAADLQAVVWDWVASGLDKDYLKPDD

SEQ ID NO: 1760 - protein, 28 aa, Artificial Sequence
  Description of Artificial Sequence: Synthetic peptide
  C-terminus amidated
LSWAADLQAVVWDWVASGLDKDYLKPDD

SEQ ID NO: 1761 - protein, 28 aa, Artificial Sequence
  Description of Artificial Sequence: Synthetic peptide
  N-terminus acetylated
  C-terminus amidated
LSWAADLQAVVWDWVASGLDKDYLKPDD

SEQ ID NO: 1762 - protein, 28 aa, Artificial Sequence
  Description of Artificial Sequence: Synthetic peptide
  C-terminus amidated
LSTAADVQAVVWDWVASGLDKDYLKPDD

SEQ ID NO: 1763 - protein, 28 aa, Artificial Sequence
  Description of Artificial Sequence: Synthetic peptide
  N-terminus acetylated
  C-terminus amidated
LSTAADVQAVVWDWVASGLDKDYLKPDD

SEQ ID NO: 1764 - protein, 28 aa, Artificial Sequence
  Description of Artificial Sequence: Synthetic peptide
  C-terminus amidated
LSWAADVQAVVWDWVASGLDKDYLKPDD

SEQ ID NO: 1765 - protein, 28 aa, Artificial Sequence
  Description of Artificial Sequence: Synthetic peptide
  N-terminus acetylated
  C-terminus amidated
LSWAADVQAVVWDWVASGLDKDYLKPDD

SEQ ID NO: 1766 - protein, 28 aa, Artificial Sequence
  Description of Artificial Sequence: Synthetic peptide
  C-terminus amidated
LSTAADMWAVVWDWVASGLDKDYLKPDD

SEQ ID NO: 1767 - protein, 28 aa, Artificial Sequence
  Description of Artificial Sequence: Synthetic peptide
  N-terminus acetylated
  C-terminus amidated
LSTAADMWAVVWDWVASGLDKDYLKPDD

SEQ ID NO: 1768 - protein, 28 aa, Artificial Sequence
  Description of Artificial Sequence: Synthetic peptide
  C-terminus amidated
LSWAADMWAVVWDWVASGLDKDYLKPDD

SEQ ID NO: 1769 - protein, 28 aa, Artificial Sequence
  Description of Artificial Sequence: Synthetic peptide
  N-terminus acetylated
  C-terminus amidated
LSWAADMWAVVWDWVASGLDKDYLKPDD

SEQ ID NO: 1770 - protein, 28 aa, Artificial Sequence
  Description of Artificial Sequence: Synthetic peptide
  C-terminus amidated
LSTAADLWAVVWDWVASGLDKDYLKPDD

SEQ ID NO: 1771 - protein, 28 aa, Artificial Sequence
  Description of Artificial Sequence: Synthetic peptide
  N-terminus acetylated
  C-terminus amidated
LSTAADLWAVVWDWVASGLDKDYLKPDD

SEQ ID NO: 1772 - protein, 28 aa, Artificial Sequence
  Description of Artificial Sequence: Synthetic peptide
  C-terminus amidated
LSWAADLWAVVWDWVASGLDKDYLKPDD

SEQ ID NO: 1773 - protein, 28 aa, Artificial Sequence
  Description of Artificial Sequence: Synthetic peptide
  N-terminus acetylated
  C-terminus amidated
LSWAADLWAVVWDWVASGLDKDYLKPDD

SEQ ID NO: 1774 - protein, 28 aa, Artificial Sequence
  Description of Artificial Sequence: Synthetic peptide
  C-terminus amidated
LSTAADVWAVVWDWVASGLDKDYLKPDD

SEQ ID NO: 1775 - protein, 28 aa, Artificial Sequence
  Description of Artificial Sequence: Synthetic peptide
  N-terminus acetylated
  C-terminus amidated
LSTAADVWAVVWDWVASGLDKDYLKPDD

SEQ ID NO: 1776 - protein, 28 aa, Artificial Sequence
  Description of Artificial Sequence: Synthetic peptide
  C-terminus amidated
LSWAADVWAVVWDWVASGLDKDYLKPDD

SEQ ID NO: 1777 - protein, 28 aa, Artificial Sequence
  Description of Artificial Sequence: Synthetic peptide
  N-terminus acetylated
  C-terminus amidated
LSWAADVWAVVWDWVASGLDKDYLKPDD

SEQ ID NO: 1778 - protein, 28 aa, Artificial Sequence
  Description of Artificial Sequence: Synthetic peptide
  N-terminus acetylated
  C-terminus amidated
DDPKLYDKDLGSAVWDWVVAWVDAAWSL

SEQ ID NO: 1779 - protein, 28 aa, Artificial Sequence
  Description of Artificial Sequence: Synthetic peptide
  N-terminus acetylated
DDPKLYDKDLGSAVWDWVVAWVDAAWSL

SEQ ID NO: 1780 - protein, 28 aa, Artificial Sequence
  Description of Artificial Sequence: Synthetic peptide
  N-terminus acetylated
  C-terminus amidated
DDPKLYDKDLGSAVWDWVVAWVDAATSL

SEQ ID NO: 1781 - protein, 28 aa, Artificial Sequence
  Description of Artificial Sequence: Synthetic peptide
  N-terminus acetylated
DDPKLYDKDLGSAVWDWVVAWVDAATSL

SEQ ID NO: 1782 - protein, 28 aa, Artificial Sequence
  Description of Artificial Sequence: Synthetic peptide
  N-terminus acetylated
  C-terminus amidated
DDPKLYDKDLGSAVWDWVVAWLDAAWSL

SEQ ID NO: 1783 - protein, 28 aa, Artificial Sequence
  Description of Artificial Sequence: Synthetic peptide
  N-terminus acetylated
DDPKLYDKDLGSAVWDWVVAWLDAAWSL

SEQ ID NO: 1784 - protein, 28 aa, Artificial Sequence
  Description of Artificial Sequence: Synthetic peptide
  N-terminus acetylated
  C-terminus amidated
DDPKLYDKDLGSAVWDWVVAWLDAATSL

SEQ ID NO: 1785 - protein, 28 aa, Artificial Sequence
  Description of Artificial Sequence: Synthetic peptide
  N-terminus acetylated
DDPKLYDKDLGSAVWDWVVAWLDAATSL

SEQ ID NO: 1786 - protein, 28 aa, Artificial Sequence
  Description of Artificial Sequence: Synthetic peptide
  N-terminus acetylated
  C-terminus amidated
DDPKLYDKDLGSAVWDWVVAWMDAAWSL

SEQ ID NO: 1787 - protein, 28 aa, Artificial Sequence
  Description of Artificial Sequence: Synthetic peptide
  N-terminus acetylated
DDPKLYDKDLGSAVWDWVVAWMDAAWSL

SEQ ID NO: 1788 - protein, 28 aa, Artificial Sequence
  Description of Artificial Sequence: Synthetic peptide
  N-terminus acetylated
  C-terminus amidated
DDPKLYDKDLGSAVWDWVVAWMDAATSL

SEQ ID NO: 1789 - protein, 28 aa, Artificial Sequence
  Description of Artificial Sequence: Synthetic peptide
  N-terminus acetylated
DDPKLYDKDLGSAVWDWVVAWMDAATSL

SEQ ID NO: 1790 - protein, 28 aa, Artificial Sequence
  Description of Artificial Sequence: Synthetic peptide
  N-terminus acetylated
  C-terminus amidated
DDPKLYDKDLGSAVWDWVVAQVDAAWSL

SEQ ID NO: 1791 - protein, 28 aa, Artificial Sequence
  Description of Artificial Sequence: Synthetic peptide
  N-terminus acetylated
DDPKLYDKDLGSAVWDWVVAQVDAAWSL

SEQ ID NO: 1792 - protein, 28 aa, Artificial Sequence
  Description of Artificial Sequence: Synthetic peptide
  N-terminus acetylated
  C-terminus amidated
DDPKLYDKDLGSAVWDWVVAQVDAATSL

SEQ ID NO: 1793 - protein, 28 aa, Artificial Sequence
  Description of Artificial Sequence: Synthetic peptide
  N-terminus acetylated
DDPKLYDKDLGSAVWDWVVAQVDAATSL

SEQ ID NO: 1794 - protein, 28 aa, Artificial Sequence
  Description of Artificial Sequence: Synthetic peptide
  N-terminus acetylated
  C-terminus amidated
DDPKLYDKDLGSAVWDWVVAQLDAAWSL

SEQ ID NO: 1795 - protein, 28 aa, Artificial Sequence
  Description of Artificial Sequence: Synthetic peptide
  N-terminus acetylated
DDPKLYDKDLGSAVWDWVVAQLDAAWSL

SEQ ID NO: 1796 - protein, 28 aa, Artificial Sequence
  Description of Artificial Sequence: Synthetic peptide
  N-terminus acetylated
  C-terminus amidated
DDPKLYDKDLGSAVWDWVVAQLDAATSL

SEQ ID NO: 1797 - protein, 28 aa, Artificial Sequence
  Description of Artificial Sequence: Synthetic peptide
  N-terminus acetylated
DDPKLYDKDLGSAVWDWVVAQLDAATSL

SEQ ID NO: 1798 - protein, 28 aa, Artificial Sequence
  Description of Artificial Sequence: Synthetic peptide
  N-terminus acetylated
  C-terminus amidated
DDPKLYDKDLGSAVWDWVVAQMDAAWSL

SEQ ID NO: 1799 - protein, 28 aa, Artificial Sequence
  Description of Artificial Sequence: Synthetic peptide
  N-terminus acetylated
DDPKLYDKDLGSAVWDWVVAQMDAAWSL

SEQ ID NO: 1800 - protein, 28 aa, Artificial Sequence
  Description of Artificial Sequence: Synthetic peptide
  N-terminus acetylated
  C-terminus amidated
DDPKLYDKDLGSAVWDWVVAQMDAATSL

SEQ ID NO: 1801 - protein, 28 aa, Artificial Sequence
  Description of Artificial Sequence: Synthetic peptide
  N-terminus acetylated
DDPKLYDKDLGSAVWDWVVAQMDAATSL

SEQ ID NO: 1802 - protein, 28 aa, Artificial Sequence
  Description of Artificial Sequence: Synthetic peptide
  N-terminus acetylated
  C-terminus amidated
DDPKLYDKDLGSAVWDWVVGWVDAAWSL

SEQ ID NO: 1803 - protein, 28 aa, Artificial Sequence
  Description of Artificial Sequence: Synthetic peptide
  N-terminus acetylated
DDPKLYDKDLGSAVWDWVVGWVDAAWSL

SEQ ID NO: 1804 - protein, 28 aa, Artificial Sequence
  Description of Artificial Sequence: Synthetic peptide
  N-terminus acetylated
  C-terminus amidated
DDPKLYDKDLGSAVWDWVVGWVDAATSL

SEQ ID NO: 1805 - protein, 28 aa, Artificial Sequence
  Description of Artificial Sequence: Synthetic peptide
  N-terminus acetylated
DDPKLYDKDLGSAVWDWVVGWVDAATSL

SEQ ID NO: 1806 - protein, 28 aa, Artificial Sequence
  Description of Artificial Sequence: Synthetic peptide
  N-terminus acetylated
  C-terminus amidated
DDPKLYDKDLGSAVWDWVVGWLDAAWSL

SEQ ID NO: 1807 - protein, 28 aa, Artificial Sequence
  Description of Artificial Sequence: Synthetic peptide
  N-terminus acetylated
DDPKLYDKDLGSAVWDWVVGWLDAAWSL

SEQ ID NO: 1808 - protein, 28 aa, Artificial Sequence
  Description of Artificial Sequence: Synthetic peptide
  N-terminus acetylated
  C-terminus amidated
DDPKLYDKDLGSAVWDWVVGWLDAATSL

SEQ ID NO: 1809 - protein, 28 aa, Artificial Sequence
  Description of Artificial Sequence: Synthetic peptide
  N-terminus acetylated
DDPKLYDKDLGSAVWDWVVGWLDAATSL

SEQ ID NO: 1810 - protein, 28 aa, Artificial Sequence
  Description of Artificial Sequence: Synthetic peptide
  N-terminus acetylated
  C-terminus amidated
DDPKLYDKDLGSAVWDWVVGWMDAAWSL

SEQ ID NO: 1811 - protein, 28 aa, Artificial Sequence
  Description of Artificial Sequence: Synthetic peptide
  N-terminus acetylated
DDPKLYDKDLGSAVWDWVVGWMDAAWSL

SEQ ID NO: 1812 - protein, 28 aa, Artificial Sequence
  Description of Artificial Sequence: Synthetic peptide
  N-terminus acetylated
  C-terminus amidated
DDPKLYDKDLGSAVWDWVVGWMDAATSL

SEQ ID NO: 1813 - protein, 28 aa, Artificial Sequence
  Description of Artificial Sequence: Synthetic peptide
  N-terminus acetylated
DDPKLYDKDLGSAVWDWVVGWMDAATSL

SEQ ID NO: 1814 - protein, 28 aa, Artificial Sequence
  Description of Artificial Sequence: Synthetic peptide
  N-terminus acetylated
  C-terminus amidated
DDPKLYDKDLGSAVWDWVVGQVDAAWSL

SEQ ID NO: 1815 - protein, 28 aa, Artificial Sequence
  Description of Artificial Sequence: Synthetic peptide
  N-terminus acetylated
DDPKLYDKDLGSAVWDWVVGQVDAAWSL

SEQ ID NO: 1816 - protein, 28 aa, Artificial Sequence
  Description of Artificial Sequence: Synthetic peptide
  N-terminus acetylated
  C-terminus amidated
DDPKLYDKDLGSAVWDWVVGQVDAATSL

SEQ ID NO: 1817 - protein, 28 aa, Artificial Sequence
  Description of Artificial Sequence: Synthetic peptide
  N-terminus acetylated
DDPKLYDKDLGSAVWDWVVGQVDAATSL

SEQ ID NO: 1818 - protein, 28 aa, Artificial Sequence
  Description of Artificial Sequence: Synthetic peptide
  N-terminus acetylated
  C-terminus amidated
DDPKLYDKDLGSAVWDWVVGQLDAAWSL

SEQ ID NO: 1819 - protein, 28 aa, Artificial Sequence
  Description of Artificial Sequence: Synthetic peptide
  N-terminus acetylated
DDPKLYDKDLGSAVWDWVVGQLDAAWSL

SEQ ID NO: 1820 - protein, 28 aa, Artificial Sequence
  Description of Artificial Sequence: Synthetic peptide
  N-terminus acetylated
  C-terminus amidated
DDPKLYDKDLGSAVWDWVVGQLDAATSL

SEQ ID NO: 1821 - protein, 28 aa, Artificial Sequence
  Description of Artificial Sequence: Synthetic peptide
  N-terminus acetylated
DDPKLYDKDLGSAVWDWVVGQLDAATSL

SEQ ID NO: 1822 - protein, 28 aa, Artificial Sequence
  Description of Artificial Sequence: Synthetic peptide
  N-terminus acetylated
  C-terminus amidated
DDPKLYDKDLGSAVWDWVVGQMDAAWSL

SEQ ID NO: 1823 - protein, 28 aa, Artificial Sequence
  Description of Artificial Sequence: Synthetic peptide
  N-terminus acetylated
DDPKLYDKDLGSAVWDWVVGQMDAAWSL

SEQ ID NO: 1824 - protein, 28 aa, Artificial Sequence
  Description of Artificial Sequence: Synthetic peptide
  N-terminus acetylated
  C-terminus amidated
DDPKLYDKDLGSAVWDWVVGQMDAATSL

SEQ ID NO: 1825 - protein, 28 aa, Artificial Sequence
  Description of Artificial Sequence: Synthetic peptide
  N-terminus acetylated
DDPKLYDKDLGSAVWDWVVGQMDAATSL

SEQ ID NO: 1826 - protein, 28 aa, Artificial Sequence
  Description of Artificial Sequence: Synthetic peptide
  N-terminus acetylated
  C-terminus amidated
DDPKLYDKDLGSAVWDTVVAWVDAAWSL

SEQ ID NO: 1827 - protein, 28 aa, Artificial Sequence
  Description of Artificial Sequence: Synthetic peptide
  N-terminus acetylated
DDPKLYDKDLGSAVWDTVVAWVDAAWSL

SEQ ID NO: 1828 - protein, 28 aa, Artificial Sequence
  Description of Artificial Sequence: Synthetic peptide
  N-terminus acetylated
  C-terminus amidated
DDPKLYDKDLGSAVWDTVVAWVDAATSL

SEQ ID NO: 1829 - protein, 28 aa, Artificial Sequence
  Description of Artificial Sequence: Synthetic peptide
  N-terminus acetylated
DDPKLYDKDLGSAVWDTVVAWVDAATSL

SEQ ID NO: 1830 - protein, 28 aa, Artificial Sequence
  Description of Artificial Sequence: Synthetic peptide
  N-terminus acetylated
  C-terminus amidated
DDPKLYDKDLGSAVWDTVVAWLDAAWSL

SEQ ID NO: 1831 - protein, 28 aa, Artificial Sequence
  Description of Artificial Sequence: Synthetic peptide
  N-terminus acetylated
DDPKLYDKDLGSAVWDTVVAWLDAAWSL

SEQ ID NO: 1832 - protein, 28 aa, Artificial Sequence
  Description of Artificial Sequence: Synthetic peptide
  N-terminus acetylated
  C-terminus amidated
DDPKLYDKDLGSAVWDTVVAWLDAATSL

SEQ ID NO: 1833 - protein, 28 aa, Artificial Sequence
  Description of Artificial Sequence: Synthetic peptide
  N-terminus acetylated
DDPKLYDKDLGSAVWDTVVAWLDAATSL

SEQ ID NO: 1834 - protein, 28 aa, Artificial Sequence
  Description of Artificial Sequence: Synthetic peptide
  N-terminus acetylated
  C-terminus amidated
DDPKLYDKDLGSAVWDTVVAWMDAAWSL

SEQ ID NO: 1835 - protein, 28 aa, Artificial Sequence
  Description of Artificial Sequence: Synthetic peptide
  N-terminus acetylated
DDPKLYDKDLGSAVWDTVVAWMDAAWSL

SEQ ID NO: 1836 - protein, 28 aa, Artificial Sequence
  Description of Artificial Sequence: Synthetic peptide
  N-terminus acetylated
  C-terminus amidated
DDPKLYDKDLGSAVWDTVVAWMDAATSL

SEQ ID NO: 1837 - protein, 28 aa, Artificial Sequence
  Description of Artificial Sequence: Synthetic peptide
  N-terminus acetylated
DDPKLYDKDLGSAVWDTVVAWMDAATSL

SEQ ID NO: 1838 - protein, 28 aa, Artificial Sequence
  Description of Artificial Sequence: Synthetic peptide
  N-terminus acetylated
  C-terminus amidated
DDPKLYDKDLGSAVWDTVVAQVDAAWSL

SEQ ID NO: 1839 - protein, 28 aa, Artificial Sequence
  Description of Artificial Sequence: Synthetic peptide
  N-terminus acetylated
DDPKLYDKDLGSAVWDTVVAQVDAAWSL

SEQ ID NO: 1840 - protein, 28 aa, Artificial Sequence
  Description of Artificial Sequence: Synthetic peptide
  N-terminus acetylated
  C-terminus amidated
DDPKLYDKDLGSAVWDTVVAQVDAATSL

SEQ ID NO: 1841 - protein, 28 aa, Artificial Sequence
  Description of Artificial Sequence: Synthetic peptide
  N-terminus acetylated
DDPKLYDKDLGSAVWDTVVAQVDAATSL

SEQ ID NO: 1842 - protein, 28 aa, Artificial Sequence
  Description of Artificial Sequence: Synthetic peptide
  N-terminus acetylated
  C-terminus amidated
DDPKLYDKDLGSAVWDTVVAQLDAAWSL

SEQ ID NO: 1843 - protein, 28 aa, Artificial Sequence
  Description of Artificial Sequence: Synthetic peptide
  N-terminus acetylated
DDPKLYDKDLGSAVWDTVVAQLDAAWSL

SEQ ID NO: 1844 - protein, 28 aa, Artificial Sequence
  Description of Artificial Sequence: Synthetic peptide
  N-terminus acetylated
  C-terminus amidated
DDPKLYDKDLGSAVWDTVVAQLDAATSL

SEQ ID NO: 1845 - protein, 28 aa, Artificial Sequence
  Description of Artificial Sequence: Synthetic peptide
  N-terminus acetylated
DDPKLYDKDLGSAVWDTVVAQLDAATSL

SEQ ID NO: 1846 - protein, 28 aa, Artificial Sequence
  Description of Artificial Sequence: Synthetic peptide
  N-terminus acetylated
  C-terminus amidated
DDPKLYDKDLGSAVWDTVVAQMDAAWSL

SEQ ID NO: 1847 - protein, 28 aa, Artificial Sequence
  Description of Artificial Sequence: Synthetic peptide
  N-terminus acetylated
DDPKLYDKDLGSAVWDTVVAQMDAAWSL

SEQ ID NO: 1848 - protein, 28 aa, Artificial Sequence
  Description of Artificial Sequence: Synthetic peptide
  N-terminus acetylated
  C-terminus amidated
DDPKLYDKDLGSAVWDTVVAQMDAATSL

SEQ ID NO: 1849 - protein, 28 aa, Artificial Sequence
  Description of Artificial Sequence: Synthetic peptide
  N-terminus acetylated
DDPKLYDKDLGSAVWDTVVAQMDAATSL

SEQ ID NO: 1850 - protein, 28 aa, Artificial Sequence
  Description of Artificial Sequence: Synthetic peptide
  N-terminus acetylated
  C-terminus amidated
DDPKLYDKDLGSAVWDTVVGWVDAAWSL

SEQ ID NO: 1851 - protein, 28 aa, Artificial Sequence
  Description of Artificial Sequence: Synthetic peptide
  N-terminus acetylated
DDPKLYDKDLGSAVWDTVVGWVDAAWSL

SEQ ID NO: 1852 - protein, 28 aa, Artificial Sequence
  Description of Artificial Sequence: Synthetic peptide
  N-terminus acetylated
  C-terminus amidated
DDPKLYDKDLGSAVWDTVVGWVDAATSL

SEQ ID NO: 1853 - protein, 28 aa, Artificial Sequence
  Description of Artificial Sequence: Synthetic peptide
  N-terminus acetylated
DDPKLYDKDLGSAVWDTVVGWVDAATSL

SEQ ID NO: 1854 - protein, 28 aa, Artificial Sequence
  Description of Artificial Sequence: Synthetic peptide
  N-terminus acetylated
  C-terminus amidated
DDPKLYDKDLGSAVWDTVVGWLDAAWSL

SEQ ID NO: 1855 - protein, 28 aa, Artificial Sequence
  Description of Artificial Sequence: Synthetic peptide
  N-terminus acetylated
DDPKLYDKDLGSAVWDTVVGWLDAAWSL

SEQ ID NO: 1856 - protein, 28 aa, Artificial Sequence
  Description of Artificial Sequence: Synthetic peptide
  N-terminus acetylated
  C-terminus amidated
DDPKLYDKDLGSAVWDTVVGWLDAATSL

SEQ ID NO: 1857 - protein, 28 aa, Artificial Sequence
  Description of Artificial Sequence: Synthetic peptide
  N-terminus acetylated
DDPKLYDKDLGSAVWDTVVGWLDAATSL

SEQ ID NO: 1858 - protein, 28 aa, Artificial Sequence
  Description of Artificial Sequence: Synthetic peptide
  N-terminus acetylated
  C-terminus amidated
DDPKLYDKDLGSAVWDTVVGWMDAAWSL

SEQ ID NO: 1859 - protein, 28 aa, Artificial Sequence
  Description of Artificial Sequence: Synthetic peptide
  N-terminus acetylated
DDPKLYDKDLGSAVWDTVVGWMDAAWSL

SEQ ID NO: 1860 - protein, 28 aa, Artificial Sequence
  Description of Artificial Sequence: Synthetic peptide
  N-terminus acetylated
  C-terminus amidated
DDPKLYDKDLGSAVWDTVVGWMDAATSL

SEQ ID NO: 1861 - protein, 28 aa, Artificial Sequence
  Description of Artificial Sequence: Synthetic peptide
  N-terminus acetylated
DDPKLYDKDLGSAVWDTVVGWMDAATSL

SEQ ID NO: 1862 - protein, 28 aa, Artificial Sequence
  Description of Artificial Sequence: Synthetic peptide
  N-terminus acetylated
  C-terminus amidated
DDPKLYDKDLGSAVWDTVVGQVDAAWSL

SEQ ID NO: 1863 - protein, 28 aa, Artificial Sequence
  Description of Artificial Sequence: Synthetic peptide
  N-terminus acetylated
DDPKLYDKDLGSAVWDTVVGQVDAAWSL

SEQ ID NO: 1864 - protein, 28 aa, Artificial Sequence
  Description of Artificial Sequence: Synthetic peptide
  N-terminus acetylated
  C-terminus amidated
DDPKLYDKDLGSAVWDTVVGQVDAATSL

SEQ ID NO: 1865 - protein, 28 aa, Artificial Sequence
  Description of Artificial Sequence: Synthetic peptide
  N-terminus acetylated
DDPKLYDKDLGSAVWDTVVGQVDAATSL

SEQ ID NO: 1866 - protein, 28 aa, Artificial Sequence
  Description of Artificial Sequence: Synthetic peptide
  N-terminus acetylated
  C-terminus amidated
DDPKLYDKDLGSAVWDTVVGQLDAAWSL

SEQ ID NO: 1867 - protein, 28 aa, Artificial Sequence
  Description of Artificial Sequence: Synthetic peptide
  N-terminus acetylated
DDPKLYDKDLGSAVWDTVVGQLDAAWSL

SEQ ID NO: 1868 - protein, 28 aa, Artificial Sequence
  Description of Artificial Sequence: Synthetic peptide
  N-terminus acetylated
  C-terminus amidated
DDPKLYDKDLGSAVWDTVVGQLDAATSL

SEQ ID NO: 1869 - protein, 28 aa, Artificial Sequence
  Description of Artificial Sequence: Synthetic peptide
  N-terminus acetylated
DDPKLYDKDLGSAVWDTVVGQLDAATSL

SEQ ID NO: 1870 - protein, 28 aa, Artificial Sequence
  Description of Artificial Sequence: Synthetic peptide
  N-terminus acetylated
  C-terminus amidated
DDPKLYDKDLGSAVWDTVVGQMDAAWSL

SEQ ID NO: 1871 - protein, 28 aa, Artificial Sequence
  Description of Artificial Sequence: Synthetic peptide
  N-terminus acetylated
DDPKLYDKDLGSAVWDTVVGQMDAAWSL

SEQ ID NO: 1872 - protein, 28 aa, Artificial Sequence
  Description of Artificial Sequence: Synthetic peptide
  N-terminus acetylated
  C-terminus amidated
DDPKLYDKDLGSAVWDTVVGQMDAATSL

SEQ ID NO: 1873 - protein, 28 aa, Artificial Sequence
  Description of Artificial Sequence: Synthetic peptide
  N-terminus acetylated
DDPKLYDKDLGSAVWDTVVGQMDAATSL

SEQ ID NO: 1874 - protein, 28 aa, Artificial Sequence
  Description of Artificial Sequence: Synthetic peptide
  N-terminus acetylated
  C-terminus amidated
DDPKLYDKDLGSAVTDWVVAWVDAAWSL

SEQ ID NO: 1875 - protein, 28 aa, Artificial Sequence
  Description of Artificial Sequence: Synthetic peptide
  N-terminus acetylated
DDPKLYDKDLGSAVTDWVVAWVDAAWSL

SEQ ID NO: 1876 - protein, 28 aa, Artificial Sequence
  Description of Artificial Sequence: Synthetic peptide
  N-terminus acetylated
  C-terminus amidated
DDPKLYDKDLGSAVTDWVVAWVDAATSL

SEQ ID NO: 1877 - protein, 28 aa, Artificial Sequence
  Description of Artificial Sequence: Synthetic peptide
  N-terminus acetylated
DDPKLYDKDLGSAVTDWVVAWVDAATSL

SEQ ID NO: 1878 - protein, 28 aa, Artificial Sequence
  Description of Artificial Sequence: Synthetic peptide
  N-terminus acetylated
  C-terminus amidated
DDPKLYDKDLGSAVTDWVVAWLDAAWSL

SEQ ID NO: 1879 - protein, 28 aa, Artificial Sequence
  Description of Artificial Sequence: Synthetic peptide
  N-terminus acetylated
DDPKLYDKDLGSAVTDWVVAWLDAAWSL

SEQ ID NO: 1880 - protein, 28 aa, Artificial Sequence
  Description of Artificial Sequence: Synthetic peptide
  N-terminus acetylated
  C-terminus amidated
DDPKLYDKDLGSAVTDWVVAWLDAATSL

SEQ ID NO: 1881 - protein, 28 aa, Artificial Sequence
  Description of Artificial Sequence: Synthetic peptide
  N-terminus acetylated
DDPKLYDKDLGSAVTDWVVAWLDAATSL

SEQ ID NO: 1882 - protein, 28 aa, Artificial Sequence
  Description of Artificial Sequence: Synthetic peptide
  N-terminus acetylated
  C-terminus amidated
DDPKLYDKDLGSAVTDWVVAWMDAAWSL

SEQ ID NO: 1883 - protein, 28 aa, Artificial Sequence
  Description of Artificial Sequence: Synthetic peptide
  N-terminus acetylated
DDPKLYDKDLGSAVTDWVVAWMDAAWSL

SEQ ID NO: 1884 - protein, 28 aa, Artificial Sequence
  Description of Artificial Sequence: Synthetic peptide
  N-terminus acetylated
  C-terminus amidated
DDPKLYDKDLGSAVTDWVVAWMDAATSL

SEQ ID NO: 1885 - protein, 28 aa, Artificial Sequence
  Description of Artificial Sequence: Synthetic peptide
  N-terminus acetylated
DDPKLYDKDLGSAVTDWVVAWMDAATSL

SEQ ID NO: 1886 - protein, 28 aa, Artificial Sequence
  Description of Artificial Sequence: Synthetic peptide
  N-terminus acetylated
  C-terminus amidated
DDPKLYDKDLGSAVTDWVVAQVDAAWSL

SEQ ID NO: 1887 - protein, 28 aa, Artificial Sequence
  Description of Artificial Sequence: Synthetic peptide
  N-terminus acetylated
DDPKLYDKDLGSAVTDWVVAQVDAAWSL

SEQ ID NO: 1888 - protein, 28 aa, Artificial Sequence
  Description of Artificial Sequence: Synthetic peptide
  N-terminus acetylated
  C-terminus amidated
DDPKLYDKDLGSAVTDWVVAQVDAATSL

SEQ ID NO: 1889 - protein, 28 aa, Artificial Sequence
  Description of Artificial Sequence: Synthetic peptide
  N-terminus acetylated
DDPKLYDKDLGSAVTDWVVAQVDAATSL

SEQ ID NO: 1890 - protein, 28 aa, Artificial Sequence
  Description of Artificial Sequence: Synthetic peptide
  N-terminus acetylated
  C-terminus amidated
DDPKLYDKDLGSAVTDWVVAQLDAAWSL

SEQ ID NO: 1891 - protein, 28 aa, Artificial Sequence
  Description of Artificial Sequence: Synthetic peptide
  N-terminus acetylated
DDPKLYDKDLGSAVTDWVVAQLDAAWSL

SEQ ID NO: 1892 - protein, 28 aa, Artificial Sequence
  Description of Artificial Sequence: Synthetic peptide
  N-terminus acetylated
  C-terminus amidated
DDPKLYDKDLGSAVTDWVVAQLDAATSL

SEQ ID NO: 1893 - protein, 28 aa, Artificial Sequence
  Description of Artificial Sequence: Synthetic peptide
  N-terminus acetylated
DDPKLYDKDLGSAVTDWVVAQLDAATSL

SEQ ID NO: 1894 - protein, 28 aa, Artificial Sequence
  Description of Artificial Sequence: Synthetic peptide
  N-terminus acetylated
  C-terminus amidated
DDPKLYDKDLGSAVTDWVVAQMDAAWSL

SEQ ID NO: 1895 - protein, 28 aa, Artificial Sequence
  Description of Artificial Sequence: Synthetic peptide
  N-terminus acetylated
DDPKLYDKDLGSAVTDWVVAQMDAAWSL

SEQ ID NO: 1896 - protein, 28 aa, Artificial Sequence
  Description of Artificial Sequence: Synthetic peptide
  N-terminus acetylated
  C-terminus amidated
DDPKLYDKDLGSAVTDWVVAQMDAATSL

SEQ ID NO: 1897 - protein, 28 aa, Artificial Sequence
  Description of Artificial Sequence: Synthetic peptide
  N-terminus acetylated
DDPKLYDKDLGSAVTDWVVAQMDAATSL

SEQ ID NO: 1898 - protein, 28 aa, Artificial Sequence
  Description of Artificial Sequence: Synthetic peptide
  N-terminus acetylated
  C-terminus amidated
DDPKLYDKDLGSAVTDWVVGWVDAAWSL

SEQ ID NO: 1899 - protein, 28 aa, Artificial Sequence
  Description of Artificial Sequence: Synthetic peptide
  N-terminus acetylated
DDPKLYDKDLGSAVTDWVVGWVDAAWSL

SEQ ID NO: 1900 - protein, 28 aa, Artificial Sequence
  Description of Artificial Sequence: Synthetic peptide
  N-terminus acetylated
  C-terminus amidated
DDPKLYDKDLGSAVTDWVVGWVDAATSL

SEQ ID NO: 1901 - protein, 28 aa, Artificial Sequence
  Description of Artificial Sequence: Synthetic peptide
  N-terminus acetylated
DDPKLYDKDLGSAVTDWVVGWVDAATSL

SEQ ID NO: 1902 - protein, 28 aa, Artificial Sequence
  Description of Artificial Sequence: Synthetic peptide
  N-terminus acetylated
  C-terminus amidated
DDPKLYDKDLGSAVTDWVVGWLDAAWSL

SEQ ID NO: 1903 - protein, 28 aa, Artificial Sequence
  Description of Artificial Sequence: Synthetic peptide
  N-terminus acetylated
DDPKLYDKDLGSAVTDWVVGWLDAAWSL

SEQ ID NO: 1904 - protein, 28 aa, Artificial Sequence
  Description of Artificial Sequence: Synthetic peptide
  N-terminus acetylated
  C-terminus amidated
DDPKLYDKDLGSAVTDWVVGWLDAATSL

SEQ ID NO: 1905 - protein, 28 aa, Artificial Sequence
  Description of Artificial Sequence: Synthetic peptide
  N-terminus acetylated
DDPKLYDKDLGSAVTDWVVGWLDAATSL

SEQ ID NO: 1906 - protein, 28 aa, Artificial Sequence
  Description of Artificial Sequence: Synthetic peptide
  N-terminus acetylated
  C-terminus amidated
DDPKLYDKDLGSAVTDWVVGWMDAAWSL

SEQ ID NO: 1907 - protein, 28 aa, Artificial Sequence
  Description of Artificial Sequence: Synthetic peptide
  N-terminus acetylated
DDPKLYDKDLGSAVTDWVVGWMDAAWSL

SEQ ID NO: 1908 - protein, 28 aa, Artificial Sequence
  Description of Artificial Sequence: Synthetic peptide
  N-terminus acetylated
  C-terminus amidated
DDPKLYDKDLGSAVTDWVVGWMDAATSL

SEQ ID NO: 1909 - protein, 28 aa, Artificial Sequence
  Description of Artificial Sequence: Synthetic peptide
  N-terminus acetylated
DDPKLYDKDLGSAVTDWVVGWMDAATSL

SEQ ID NO: 1910 - protein, 28 aa, Artificial Sequence
  Description of Artificial Sequence: Synthetic peptide
  N-terminus acetylated
  C-terminus amidated
DDPKLYDKDLGSAVTDWVVGQVDAAWSL

SEQ ID NO: 1911 - protein, 28 aa, Artificial Sequence
  Description of Artificial Sequence: Synthetic peptide
  N-terminus acetylated
DDPKLYDKDLGSAVTDWVVGQVDAAWSL

SEQ ID NO: 1912 - protein, 28 aa, Artificial Sequence
  Description of Artificial Sequence: Synthetic peptide
  N-terminus acetylated
  C-terminus amidated
DDPKLYDKDLGSAVTDWVVGQVDAATSL

SEQ ID NO: 1913 - protein, 28 aa, Artificial Sequence
  Description of Artificial Sequence: Synthetic peptide
  N-terminus acetylated
DDPKLYDKDLGSAVTDWVVGQVDAATSL

SEQ ID NO: 1914 - protein, 28 aa, Artificial Sequence
  Description of Artificial Sequence: Synthetic peptide
  N-terminus acetylated
  C-terminus amidated
DDPKLYDKDLGSAVTDWVVGQLDAAWSL

SEQ ID NO: 1915 - protein, 28 aa, Artificial Sequence
  Description of Artificial Sequence: Synthetic peptide
  N-terminus acetylated
DDPKLYDKDLGSAVTDWVVGQLDAAWSL

SEQ ID NO: 1916 - protein, 28 aa, Artificial Sequence
  Description of Artificial Sequence: Synthetic peptide
  N-terminus acetylated
  C-terminus amidated
DDPKLYDKDLGSAVTDWVVGQLDAATSL

SEQ ID NO: 1917 - protein, 28 aa, Artificial Sequence
  Description of Artificial Sequence: Synthetic peptide
  N-terminus acetylated
DDPKLYDKDLGSAVTDWVVGQLDAATSL

SEQ ID NO: 1918 - protein, 28 aa, Artificial Sequence
  Description of Artificial Sequence: Synthetic peptide
  N-terminus acetylated
  C-terminus amidated
DDPKLYDKDLGSAVTDWVVGQMDAAWSL

SEQ ID NO: 1919 - protein, 28 aa, Artificial Sequence
  Description of Artificial Sequence: Synthetic peptide
  N-terminus acetylated
DDPKLYDKDLGSAVTDWVVGQMDAAWSL

SEQ ID NO: 1920 - protein, 28 aa, Artificial Sequence
  Description of Artificial Sequence: Synthetic peptide
  N-terminus acetylated
  C-terminus amidated
DDPKLYDKDLGSAVTDWVVGQMDAATSL

SEQ ID NO: 1921 - protein, 28 aa, Artificial Sequence
  Description of Artificial Sequence: Synthetic peptide
  N-terminus acetylated
DDPKLYDKDLGSAVTDWVVGQMDAATSL

SEQ ID NO: 1922 - protein, 28 aa, Artificial Sequence
  Description of Artificial Sequence: Synthetic peptide
  N-terminus acetylated
  C-terminus amidated
DDPKLYDKDLGSAVTDTVVAWVDAAWSL

SEQ ID NO: 1923 - protein, 28 aa, Artificial Sequence
  Description of Artificial Sequence: Synthetic peptide
  N-terminus acetylated
DDPKLYDKDLGSAVTDTVVAWVDAAWSL

SEQ ID NO: 1924 - protein, 28 aa, Artificial Sequence
  Description of Artificial Sequence: Synthetic peptide
  N-terminus acetylated
  C-terminus amidated
DDPKLYDKDLGSAVTDTVVAWVDAATSL

SEQ ID NO: 1925 - protein, 28 aa, Artificial Sequence
  Description of Artificial Sequence: Synthetic peptide
  N-terminus acetylated
DDPKLYDKDLGSAVTDTVVAWVDAATSL

SEQ ID NO: 1926 - protein, 28 aa, Artificial Sequence
  Description of Artificial Sequence: Synthetic peptide
  N-terminus acetylated
  C-terminus amidated
DDPKLYDKDLGSAVTDTVVAWLDAAWSL

SEQ ID NO: 1927 - protein, 28 aa, Artificial Sequence
  Description of Artificial Sequence: Synthetic peptide
  N-terminus acetylated
DDPKLYDKDLGSAVTDTVVAWLDAAWSL

SEQ ID NO: 1928 - protein, 28 aa, Artificial Sequence
  Description of Artificial Sequence: Synthetic peptide
  N-terminus acetylated
  C-terminus amidated
DDPKLYDKDLGSAVTDTVVAWLDAATSL

SEQ ID NO: 1929 - protein, 28 aa, Artificial Sequence
  Description of Artificial Sequence: Synthetic peptide
  N-terminus acetylated
DDPKLYDKDLGSAVTDTVVAWLDAATSL

SEQ ID NO: 1930 - protein, 28 aa, Artificial Sequence
  Description of Artificial Sequence: Synthetic peptide
  N-terminus acetylated
  C-terminus amidated
DDPKLYDKDLGSAVTDTVVAWMDAAWSL

SEQ ID NO: 1931 - protein, 28 aa, Artificial Sequence
  Description of Artificial Sequence: Synthetic peptide
  N-terminus acetylated
DDPKLYDKDLGSAVTDTVVAWMDAAWSL

SEQ ID NO: 1932 - protein, 28 aa, Artificial Sequence
  Description of Artificial Sequence: Synthetic peptide
  N-terminus acetylated
  C-terminus amidated
DDPKLYDKDLGSAVTDTVVAWMDAATSL

SEQ ID NO: 1933 - protein, 28 aa, Artificial Sequence
  Description of Artificial Sequence: Synthetic peptide
  N-terminus acetylated
DDPKLYDKDLGSAVTDTVVAWMDAATSL

SEQ ID NO: 1934 - protein, 28 aa, Artificial Sequence
  Description of Artificial Sequence: Synthetic peptide
  N-terminus acetylated
  C-terminus amidated
DDPKLYDKDLGSAVTDTVVAQVDAAWSL

SEQ ID NO: 1935 - protein, 28 aa, Artificial Sequence
  Description of Artificial Sequence: Synthetic peptide
  N-terminus acetylated
DDPKLYDKDLGSAVTDTVVAQVDAAWSL

SEQ ID NO: 1936 - protein, 28 aa, Artificial Sequence
  Description of Artificial Sequence: Synthetic peptide
  N-terminus acetylated
  C-terminus amidated
DDPKLYDKDLGSAVTDTVVAQVDAATSL

SEQ ID NO: 1937 - protein, 28 aa, Artificial Sequence
  Description of Artificial Sequence: Synthetic peptide
  N-terminus acetylated
DDPKLYDKDLGSAVTDTVVAQVDAATSL

SEQ ID NO: 1938 - protein, 28 aa, Artificial Sequence
  Description of Artificial Sequence: Synthetic peptide
  N-terminus acetylated
  C-terminus amidated
DDPKLYDKDLGSAVTDTVVAQLDAAWSL

SEQ ID NO: 1939 - protein, 28 aa, Artificial Sequence
  Description of Artificial Sequence: Synthetic peptide
  N-terminus acetylated
DDPKLYDKDLGSAVTDTVVAQLDAAWSL

SEQ ID NO: 1940 - protein, 28 aa, Artificial Sequence
  Description of Artificial Sequence: Synthetic peptide
  N-terminus acetylated
  C-terminus amidated
DDPKLYDKDLGSAVTDTVVAQLDAATSL

SEQ ID NO: 1941 - protein, 28 aa, Artificial Sequence
  Description of Artificial Sequence: Synthetic peptide
  N-terminus acetylated
DDPKLYDKDLGSAVTDTVVAQLDAATSL

SEQ ID NO: 1942 - protein, 28 aa, Artificial Sequence
  Description of Artificial Sequence: Synthetic peptide
  N-terminus acetylated
  C-terminus amidated
DDPKLYDKDLGSAVTDTVVAQMDAAWSL

SEQ ID NO: 1943 - protein, 28 aa, Artificial Sequence
  Description of Artificial Sequence: Synthetic peptide
  N-terminus acetylated
DDPKLYDKDLGSAVTDTVVAQMDAAWSL

SEQ ID NO: 1944 - protein, 28 aa, Artificial Sequence
  Description of Artificial Sequence: Synthetic peptide
  N-terminus acetylated
  C-terminus amidated
DDPKLYDKDLGSAVTDTVVAQMDAATSL

SEQ ID NO: 1945 - protein, 28 aa, Artificial Sequence
  Description of Artificial Sequence: Synthetic peptide
  N-terminus acetylated
DDPKLYDKDLGSAVTDTVVAQMDAATSL

SEQ ID NO: 1946 - protein, 28 aa, Artificial Sequence
  Description of Artificial Sequence: Synthetic peptide
  N-terminus acetylated
  C-terminus amidated
DDPKLYDKDLGSAVTDTVVGWVDAAWSL

SEQ ID NO: 1947 - protein, 28 aa, Artificial Sequence
  Description of Artificial Sequence: Synthetic peptide
  N-terminus acetylated
DDPKLYDKDLGSAVTDTVVGWVDAAWSL

SEQ ID NO: 1948 - protein, 28 aa, Artificial Sequence
  Description of Artificial Sequence: Synthetic peptide
  N-terminus acetylated
  C-terminus amidated
DDPKLYDKDLGSAVTDTVVGWVDAATSL

SEQ ID NO: 1949 - protein, 28 aa, Artificial Sequence
  Description of Artificial Sequence: Synthetic peptide
  N-terminus acetylated
DDPKLYDKDLGSAVTDTVVGWVDAATSL

SEQ ID NO: 1950 - protein, 28 aa, Artificial Sequence
  Description of Artificial Sequence: Synthetic peptide
  N-terminus acetylated
  C-terminus amidated
DDPKLYDKDLGSAVTDTVVGWLDAAWSL

SEQ ID NO: 1951 - protein, 28 aa, Artificial Sequence
  Description of Artificial Sequence: Synthetic peptide
  N-terminus acetylated
DDPKLYDKDLGSAVTDTVVGWLDAAWSL

SEQ ID NO: 1952 - protein, 28 aa, Artificial Sequence
  Description of Artificial Sequence: Synthetic peptide
  N-terminus acetylated
  C-terminus amidated
DDPKLYDKDLGSAVTDTVVGWLDAATSL

SEQ ID NO: 1953 - protein, 28 aa, Artificial Sequence
  Description of Artificial Sequence: Synthetic peptide
  N-terminus acetylated
DDPKLYDKDLGSAVTDTVVGWLDAATSL

SEQ ID NO: 1954 - protein, 28 aa, Artificial Sequence
  Description of Artificial Sequence: Synthetic peptide
  N-terminus acetylated
  C-terminus amidated
DDPKLYDKDLGSAVTDTVVGWMDAAWSL

SEQ ID NO: 1955 - protein, 28 aa, Artificial Sequence
  Description of Artificial Sequence: Synthetic peptide
  N-terminus acetylated
DDPKLYDKDLGSAVTDTVVGWMDAAWSL

SEQ ID NO: 1956 - protein, 28 aa, Artificial Sequence
  Description of Artificial Sequence: Synthetic peptide
  N-terminus acetylated
  C-terminus amidated
DDPKLYDKDLGSAVTDTVVGWMDAATSL

SEQ ID NO: 1957 - protein, 28 aa, Artificial Sequence
  Description of Artificial Sequence: Synthetic peptide
  N-terminus acetylated
DDPKLYDKDLGSAVTDTVVGWMDAATSL

SEQ ID NO: 1958 - protein, 28 aa, Artificial Sequence
  Description of Artificial Sequence: Synthetic peptide
  N-terminus acetylated
  C-terminus amidated
DDPKLYDKDLGSAVTDTVVGQVDAAWSL

SEQ ID NO: 1959 - protein, 28 aa, Artificial Sequence
  Description of Artificial Sequence: Synthetic peptide
  N-terminus acetylated
DDPKLYDKDLGSAVTDTVVGQVDAAWSL

SEQ ID NO: 1960 - protein, 28 aa, Artificial Sequence
  Description of Artificial Sequence: Synthetic peptide
  N-terminus acetylated
  C-terminus amidated
DDPKLYDKDLGSAVTDTVVGQVDAATSL

SEQ ID NO: 1961 - protein, 28 aa, Artificial Sequence
  Description of Artificial Sequence: Synthetic peptide
  N-terminus acetylated
DDPKLYDKDLGSAVTDTVVGQVDAATSL

SEQ ID NO: 1962 - protein, 28 aa, Artificial Sequence
  Description of Artificial Sequence: Synthetic peptide
  N-terminus acetylated
  C-terminus amidated
DDPKLYDKDLGSAVTDTVVGQLDAAWSL

SEQ ID NO: 1963 - protein, 28 aa, Artificial Sequence
  Description of Artificial Sequence: Synthetic peptide
  N-terminus acetylated
DDPKLYDKDLGSAVTDTVVGQLDAAWSL

SEQ ID NO: 1964 - protein, 28 aa, Artificial Sequence
  Description of Artificial Sequence: Synthetic peptide
  N-terminus acetylated
  C-terminus amidated
DDPKLYDKDLGSAVTDTVVGQLDAATSL

SEQ ID NO: 1965 - protein, 28 aa, Artificial Sequence
  Description of Artificial Sequence: Synthetic peptide
  N-terminus acetylated
DDPKLYDKDLGSAVTDTVVGQLDAATSL

SEQ ID NO: 1966 - protein, 28 aa, Artificial Sequence
  Description of Artificial Sequence: Synthetic peptide
  N-terminus acetylated
  C-terminus amidated
DDPKLYDKDLGSAVTDTVVGQMDAAWSL

SEQ ID NO: 1967 - protein, 28 aa, Artificial Sequence
  Description of Artificial Sequence: Synthetic peptide
  N-terminus acetylated
DDPKLYDKDLGSAVTDTVVGQMDAAWSL

SEQ ID NO: 1968 - protein, 28 aa, Artificial Sequence
  Description of Artificial Sequence: Synthetic peptide
  N-terminus acetylated
  C-terminus amidated
DDPKLYDKDLGSAVTDTVVGQMDAATSL

SEQ ID NO: 1969 - protein, 28 aa, Artificial Sequence
  Description of Artificial Sequence: Synthetic peptide
  N-terminus acetylated
DDPKLYDKDLGSAVTDTVVGQMDAATSL

SEQ ID NO: 1970 - protein, 28 aa, Artificial Sequence
  Description of Artificial Sequence: Synthetic peptide
  N-terminus acetylated
  C-terminus amidated
DDPKLYDKDLGSAVGDWVVAWVDAAWSL

SEQ ID NO: 1971 - protein, 28 aa, Artificial Sequence
  Description of Artificial Sequence: Synthetic peptide
  N-terminus acetylated
DDPKLYDKDLGSAVGDWVVAWVDAAWSL

SEQ ID NO: 1972 - protein, 28 aa, Artificial Sequence
  Description of Artificial Sequence: Synthetic peptide
  N-terminus acetylated
  C-terminus amidated
DDPKLYDKDLGSAVGDWVVAWVDAATSL

SEQ ID NO: 1973 - protein, 28 aa, Artificial Sequence
  Description of Artificial Sequence: Synthetic peptide
  N-terminus acetylated
DDPKLYDKDLGSAVGDWVVAWVDAATSL

SEQ ID NO: 1974 - protein, 28 aa, Artificial Sequence
  Description of Artificial Sequence: Synthetic peptide
  N-terminus acetylated
  C-terminus amidated
DDPKLYDKDLGSAVGDWVVAWLDAAWSL

SEQ ID NO: 1975 - protein, 28 aa, Artificial Sequence
  Description of Artificial Sequence: Synthetic peptide
  N-terminus acetylated
DDPKLYDKDLGSAVGDWVVAWLDAAWSL

SEQ ID NO: 1976 - protein, 28 aa, Artificial Sequence
  Description of Artificial Sequence: Synthetic peptide
  N-terminus acetylated
  C-terminus amidated
DDPKLYDKDLGSAVGDWVVAWLDAATSL

SEQ ID NO: 1977 - protein, 28 aa, Artificial Sequence
  Description of Artificial Sequence: Synthetic peptide
  N-terminus acetylated
DDPKLYDKDLGSAVGDWVVAWLDAATSL

SEQ ID NO: 1978 - protein, 28 aa, Artificial Sequence
  Description of Artificial Sequence: Synthetic peptide
  N-terminus acetylated
  C-terminus amidated
DDPKLYDKDLGSAVGDWVVAWMDAAWSL

SEQ ID NO: 1979 - protein, 28 aa, Artificial Sequence
  Description of Artificial Sequence: Synthetic peptide
  N-terminus acetylated
DDPKLYDKDLGSAVGDWVVAWMDAAWSL

SEQ ID NO: 1980 - protein, 28 aa, Artificial Sequence
  Description of Artificial Sequence: Synthetic peptide
  N-terminus acetylated
  C-terminus amidated
DDPKLYDKDLGSAVGDWVVAWMDAATSL

SEQ ID NO: 1981 - protein, 28 aa, Artificial Sequence
  Description of Artificial Sequence: Synthetic peptide
  N-terminus acetylated
DDPKLYDKDLGSAVGDWVVAWMDAATSL

SEQ ID NO: 1982 - protein, 28 aa, Artificial Sequence
  Description of Artificial Sequence: Synthetic peptide
  N-terminus acetylated
  C-terminus amidated
DDPKLYDKDLGSAVGDWVVAQVDAAWSL

SEQ ID NO: 1983 - protein, 28 aa, Artificial Sequence
  Description of Artificial Sequence: Synthetic peptide
  N-terminus acetylated
DDPKLYDKDLGSAVGDWVVAQVDAAWSL

SEQ ID NO: 1984 - protein, 28 aa, Artificial Sequence
  Description of Artificial Sequence: Synthetic peptide
  N-terminus acetylated
  C-terminus amidated
DDPKLYDKDLGSAVGDWVVAQVDAATSL

SEQ ID NO: 1985 - protein, 28 aa, Artificial Sequence
  Description of Artificial Sequence: Synthetic peptide
  N-terminus acetylated
DDPKLYDKDLGSAVGDWVVAQVDAATSL

SEQ ID NO: 1986 - protein, 28 aa, Artificial Sequence
  Description of Artificial Sequence: Synthetic peptide
  N-terminus acetylated
  C-terminus amidated
DDPKLYDKDLGSAVGDWVVAQLDAAWSL

SEQ ID NO: 1987 - protein, 28 aa, Artificial Sequence
  Description of Artificial Sequence: Synthetic peptide
  N-terminus acetylated
DDPKLYDKDLGSAVGDWVVAQLDAAWSL

SEQ ID NO: 1988 - protein, 28 aa, Artificial Sequence
  Description of Artificial Sequence: Synthetic peptide
  N-terminus acetylated
  C-terminus amidated
DDPKLYDKDLGSAVGDWVVAQLDAATSL

SEQ ID NO: 1989 - protein, 28 aa, Artificial Sequence
  Description of Artificial Sequence: Synthetic peptide
  N-terminus acetylated
DDPKLYDKDLGSAVGDWVVAQLDAATSL

SEQ ID NO: 1990 - protein, 28 aa, Artificial Sequence
  Description of Artificial Sequence: Synthetic peptide
  N-terminus acetylated
  C-terminus amidated
DDPKLYDKDLGSAVGDWVVAQMDAAWSL

SEQ ID NO: 1991 - protein, 28 aa, Artificial Sequence
  Description of Artificial Sequence: Synthetic peptide
  N-terminus acetylated
DDPKLYDKDLGSAVGDWVVAQMDAAWSL

SEQ ID NO: 1992 - protein, 28 aa, Artificial Sequence
  Description of Artificial Sequence: Synthetic peptide
  N-terminus acetylated
  C-terminus amidated
DDPKLYDKDLGSAVGDWVVAQMDAATSL

SEQ ID NO: 1993 - protein, 28 aa, Artificial Sequence
  Description of Artificial Sequence: Synthetic peptide
  N-terminus acetylated
DDPKLYDKDLGSAVGDWVVAQMDAATSL

SEQ ID NO: 1994 - protein, 28 aa, Artificial Sequence
  Description of Artificial Sequence: Synthetic peptide
  N-terminus acetylated
  C-terminus amidated
DDPKLYDKDLGSAVGDWVVGWVDAAWSL

SEQ ID NO: 1995 - protein, 28 aa, Artificial Sequence
  Description of Artificial Sequence: Synthetic peptide
  N-terminus acetylated
DDPKLYDKDLGSAVGDWVVGWVDAAWSL

SEQ ID NO: 1996 - protein, 28 aa, Artificial Sequence
  Description of Artificial Sequence: Synthetic peptide
  N-terminus acetylated
  C-terminus amidated
DDPKLYDKDLGSAVGDWVVGWVDAATSL

SEQ ID NO: 1997 - protein, 28 aa, Artificial Sequence
  Description of Artificial Sequence: Synthetic peptide
  N-terminus acetylated
DDPKLYDKDLGSAVGDWVVGWVDAATSL

SEQ ID NO: 1998 - protein, 28 aa, Artificial Sequence
  Description of Artificial Sequence: Synthetic peptide
  N-terminus acetylated
  C-terminus amidated
DDPKLYDKDLGSAVGDWVVGWLDAAWSL

SEQ ID NO: 1999 - protein, 28 aa, Artificial Sequence
  Description of Artificial Sequence: Synthetic peptide
  N-terminus acetylated
DDPKLYDKDLGSAVGDWVVGWLDAAWSL

SEQ ID NO: 2000 - protein, 28 aa, Artificial Sequence
  Description of Artificial Sequence: Synthetic peptide
  N-terminus acetylated
  C-terminus amidated
DDPKLYDKDLGSAVGDWVVGWLDAATSL

SEQ ID NO: 2001 - protein, 28 aa, Artificial Sequence
  Description of Artificial Sequence: Synthetic peptide
  N-terminus acetylated
DDPKLYDKDLGSAVGDWVVGWLDAATSL

SEQ ID NO: 2002 - protein, 28 aa, Artificial Sequence
  Description of Artificial Sequence: Synthetic peptide
  N-terminus acetylated
  C-terminus amidated
DDPKLYDKDLGSAVGDWVVGWMDAAWSL

SEQ ID NO: 2003 - protein, 28 aa, Artificial Sequence
  Description of Artificial Sequence: Synthetic peptide
  N-terminus acetylated
DDPKLYDKDLGSAVGDWVVGWMDAAWSL

SEQ ID NO: 2004 - protein, 28 aa, Artificial Sequence
  Description of Artificial Sequence: Synthetic peptide
  N-terminus acetylated
  C-terminus amidated
DDPKLYDKDLGSAVGDWVVGWMDAATSL

SEQ ID NO: 2005 - protein, 28 aa, Artificial Sequence
  Description of Artificial Sequence: Synthetic peptide
  N-terminus acetylated
DDPKLYDKDLGSAVGDWVVGWMDAATSL

SEQ ID NO: 2006 - protein, 28 aa, Artificial Sequence
  Description of Artificial Sequence: Synthetic peptide
  N-terminus acetylated
  C-terminus amidated
DDPKLYDKDLGSAVGDWVVGQVDAAWSL

SEQ ID NO: 2007 - protein, 28 aa, Artificial Sequence
  Description of Artificial Sequence: Synthetic peptide
  N-terminus acetylated
DDPKLYDKDLGSAVGDWVVGQVDAAWSL

SEQ ID NO: 2008 - protein, 28 aa, Artificial Sequence
  Description of Artificial Sequence: Synthetic peptide
  N-terminus acetylated
  C-terminus amidated
DDPKLYDKDLGSAVGDWVVGQVDAATSL

SEQ ID NO: 2009 - protein, 28 aa, Artificial Sequence
  Description of Artificial Sequence: Synthetic peptide
  N-terminus acetylated
DDPKLYDKDLGSAVGDWVVGQVDAATSL

SEQ ID NO: 2010 - protein, 28 aa, Artificial Sequence
  Description of Artificial Sequence: Synthetic peptide
  N-terminus acetylated
  C-terminus amidated
DDPKLYDKDLGSAVGDWVVGQLDAAWSL

SEQ ID NO: 2011 - protein, 28 aa, Artificial Sequence
  Description of Artificial Sequence: Synthetic peptide
  N-terminus acetylated
DDPKLYDKDLGSAVGDWVVGQLDAAWSL

SEQ ID NO: 2012 - protein, 28 aa, Artificial Sequence
  Description of Artificial Sequence: Synthetic peptide
  N-terminus acetylated
  C-terminus amidated
DDPKLYDKDLGSAVGDWVVGQLDAATSL

SEQ ID NO: 2013 - protein, 28 aa, Artificial Sequence
  Description of Artificial Sequence: Synthetic peptide
  N-terminus acetylated
DDPKLYDKDLGSAVGDWVVGQLDAATSL

SEQ ID NO: 2014 - protein, 28 aa, Artificial Sequence
  Description of Artificial Sequence: Synthetic peptide
  N-terminus acetylated
  C-terminus amidated
DDPKLYDKDLGSAVGDWVVGQMDAAWSL

SEQ ID NO: 2015 - protein, 28 aa, Artificial Sequence
  Description of Artificial Sequence: Synthetic peptide
  N-terminus acetylated
DDPKLYDKDLGSAVGDWVVGQMDAAWSL

SEQ ID NO: 2016 - protein, 28 aa, Artificial Sequence
  Description of Artificial Sequence: Synthetic peptide
  N-terminus acetylated
  C-terminus amidated
DDPKLYDKDLGSAVGDWVVGQMDAATSL

SEQ ID NO: 2017 - protein, 28 aa, Artificial Sequence
  Description of Artificial Sequence: Synthetic peptide
  N-terminus acetylated
DDPKLYDKDLGSAVGDWVVGQMDAATSL

SEQ ID NO: 2018 - protein, 28 aa, Artificial Sequence
  Description of Artificial Sequence: Synthetic peptide
  N-terminus acetylated
  C-terminus amidated
DDPKLYDKDLGSAVGDTVVAWVDAAWSL

SEQ ID NO: 2019 - protein, 28 aa, Artificial Sequence
  Description of Artificial Sequence: Synthetic peptide
  N-terminus acetylated
DDPKLYDKDLGSAVGDTVVAWVDAAWSL

SEQ ID NO: 2020 - protein, 28 aa, Artificial Sequence
  Description of Artificial Sequence: Synthetic peptide
  N-terminus acetylated
  C-terminus amidated
DDPKLYDKDLGSAVGDTVVAWVDAATSL

SEQ ID NO: 2021 - protein, 28 aa, Artificial Sequence
  Description of Artificial Sequence: Synthetic peptide
  N-terminus acetylated
DDPKLYDKDLGSAVGDTVVAWVDAATSL

SEQ ID NO: 2022 - protein, 28 aa, Artificial Sequence
  Description of Artificial Sequence: Synthetic peptide
  N-terminus acetylated
  C-terminus amidated
DDPKLYDKDLGSAVGDTVVAWLDAAWSL

SEQ ID NO: 2023 - protein, 28 aa, Artificial Sequence
  Description of Artificial Sequence: Synthetic peptide
  N-terminus acetylated
DDPKLYDKDLGSAVGDTVVAWLDAAWSL

SEQ ID NO: 2024 - protein, 28 aa, Artificial Sequence
  Description of Artificial Sequence: Synthetic peptide
  N-terminus acetylated
  C-terminus amidated
DDPKLYDKDLGSAVGDTVVAWLDAATSL

SEQ ID NO: 2025 - protein, 28 aa, Artificial Sequence
  Description of Artificial Sequence: Synthetic peptide
  N-terminus acetylated
DDPKLYDKDLGSAVGDTVVAWLDAATSL

SEQ ID NO: 2026 - protein, 28 aa, Artificial Sequence
  Description of Artificial Sequence: Synthetic peptide
  N-terminus acetylated
  C-terminus amidated
DDPKLYDKDLGSAVGDTVVAWMDAAWSL

SEQ ID NO: 2027 - protein, 28 aa, Artificial Sequence
  Description of Artificial Sequence: Synthetic peptide
  N-terminus acetylated
DDPKLYDKDLGSAVGDTVVAWMDAAWSL

SEQ ID NO: 2028 - protein, 28 aa, Artificial Sequence
  Description of Artificial Sequence: Synthetic peptide
  N-terminus acetylated
  C-terminus amidated
DDPKLYDKDLGSAVGDTVVAWMDAATSL

SEQ ID NO: 2029 - protein, 28 aa, Artificial Sequence
  Description of Artificial Sequence: Synthetic peptide
  N-terminus acetylated
DDPKLYDKDLGSAVGDTVVAWMDAATSL

SEQ ID NO: 2030 - protein, 28 aa, Artificial Sequence
  Description of Artificial Sequence: Synthetic peptide
  N-terminus acetylated
  C-terminus amidated
DDPKLYDKDLGSAVGDTVVAQVDAAWSL

SEQ ID NO: 2031 - protein, 28 aa, Artificial Sequence
  Description of Artificial Sequence: Synthetic peptide
  N-terminus acetylated
DDPKLYDKDLGSAVGDTVVAQVDAAWSL

SEQ ID NO: 2032 - protein, 28 aa, Artificial Sequence
  Description of Artificial Sequence: Synthetic peptide
  N-terminus acetylated
  C-terminus amidated
DDPKLYDKDLGSAVGDTVVAQVDAATSL

SEQ ID NO: 2033 - protein, 28 aa, Artificial Sequence
  Description of Artificial Sequence: Synthetic peptide
  N-terminus acetylated
DDPKLYDKDLGSAVGDTVVAQVDAATSL

SEQ ID NO: 2034 - protein, 28 aa, Artificial Sequence
  Description of Artificial Sequence: Synthetic peptide
  N-terminus acetylated
  C-terminus amidated
DDPKLYDKDLGSAVGDTVVAQLDAAWSL

SEQ ID NO: 2035 - protein, 28 aa, Artificial Sequence
  Description of Artificial Sequence: Synthetic peptide
  N-terminus acetylated
DDPKLYDKDLGSAVGDTVVAQLDAAWSL

SEQ ID NO: 2036 - protein, 28 aa, Artificial Sequence
  Description of Artificial Sequence: Synthetic peptide
  N-terminus acetylated
  C-terminus amidated
DDPKLYDKDLGSAVGDTVVAQLDAATSL

SEQ ID NO: 2037 - protein, 28 aa, Artificial Sequence
  Description of Artificial Sequence: Synthetic peptide
  N-terminus acetylated
DDPKLYDKDLGSAVGDTVVAQLDAATSL

SEQ ID NO: 2038 - protein, 28 aa, Artificial Sequence
  Description of Artificial Sequence: Synthetic peptide
  N-terminus acetylated
  C-terminus amidated
DDPKLYDKDLGSAVGDTVVAQMDAAWSL

SEQ ID NO: 2039 - protein, 28 aa, Artificial Sequence
  Description of Artificial Sequence: Synthetic peptide
  N-terminus acetylated
DDPKLYDKDLGSAVGDTVVAQMDAAWSL

SEQ ID NO: 2040 - protein, 28 aa, Artificial Sequence
  Description of Artificial Sequence: Synthetic peptide
  N-terminus acetylated
  C-terminus amidated
DDPKLYDKDLGSAVGDTVVAQMDAATSL

SEQ ID NO: 2041 - protein, 28 aa, Artificial Sequence
  Description of Artificial Sequence: Synthetic peptide
  N-terminus acetylated
DDPKLYDKDLGSAVGDTVVAQMDAATSL

SEQ ID NO: 2042 - protein, 28 aa, Artificial Sequence
  Description of Artificial Sequence: Synthetic peptide
  N-terminus acetylated
  C-terminus amidated
DDPKLYDKDLGSAVGDTVVGWVDAAWSL

SEQ ID NO: 2043 - protein, 28 aa, Artificial Sequence
  Description of Artificial Sequence: Synthetic peptide
  N-terminus acetylated
DDPKLYDKDLGSAVGDTVVGWVDAAWSL

SEQ ID NO: 2044 - protein, 28 aa, Artificial Sequence
  Description of Artificial Sequence: Synthetic peptide
  N-terminus acetylated
  C-terminus amidated
DDPKLYDKDLGSAVGDTVVGWVDAATSL

SEQ ID NO: 2045 - protein, 28 aa, Artificial Sequence
  Description of Artificial Sequence: Synthetic peptide
  N-terminus acetylated
DDPKLYDKDLGSAVGDTVVGWVDAATSL

SEQ ID NO: 2046 - protein, 28 aa, Artificial Sequence
  Description of Artificial Sequence: Synthetic peptide
  N-terminus acetylated
  C-terminus amidated
DDPKLYDKDLGSAVGDTVVGWLDAAWSL

SEQ ID NO: 2047 - protein, 28 aa, Artificial Sequence
  Description of Artificial Sequence: Synthetic peptide
  N-terminus acetylated
DDPKLYDKDLGSAVGDTVVGWLDAAWSL

SEQ ID NO: 2048 - protein, 28 aa, Artificial Sequence
  Description of Artificial Sequence: Synthetic peptide
  N-terminus acetylated
  C-terminus amidated
DDPKLYDKDLGSAVGDTVVGWLDAATSL

SEQ ID NO: 2049 - protein, 28 aa, Artificial Sequence
  Description of Artificial Sequence: Synthetic peptide
  N-terminus acetylated
DDPKLYDKDLGSAVGDTVVGWLDAATSL

SEQ ID NO: 2050 - protein, 28 aa, Artificial Sequence
  Description of Artificial Sequence: Synthetic peptide
  N-terminus acetylated
  C-terminus amidated
DDPKLYDKDLGSAVGDTVVGWMDAAWSL

SEQ ID NO: 2051 - protein, 28 aa, Artificial Sequence
  Description of Artificial Sequence: Synthetic peptide
  N-terminus acetylated
DDPKLYDKDLGSAVGDTVVGWMDAAWSL

SEQ ID NO: 2052 - protein, 28 aa, Artificial Sequence
  Description of Artificial Sequence: Synthetic peptide
  N-terminus acetylated
  C-terminus amidated
DDPKLYDKDLGSAVGDTVVGWMDAATSL

SEQ ID NO: 2053 - protein, 28 aa, Artificial Sequence
  Description of Artificial Sequence: Synthetic peptide
  N-terminus acetylated
DDPKLYDKDLGSAVGDTVVGWMDAATSL

SEQ ID NO: 2054 - protein, 28 aa, Artificial Sequence
  Description of Artificial Sequence: Synthetic peptide
  N-terminus acetylated
  C-terminus amidated
DDPKLYDKDLGSAVGDTVVGQVDAAWSL

SEQ ID NO: 2055 - protein, 28 aa, Artificial Sequence
  Description of Artificial Sequence: Synthetic peptide
  N-terminus acetylated
DDPKLYDKDLGSAVGDTVVGQVDAAWSL

SEQ ID NO: 2056 - protein, 28 aa, Artificial Sequence
  Description of Artificial Sequence: Synthetic peptide
  N-terminus acetylated
  C-terminus amidated
DDPKLYDKDLGSAVGDTVVGQVDAATSL

SEQ ID NO: 2057 - protein, 28 aa, Artificial Sequence
  Description of Artificial Sequence: Synthetic peptide
  N-terminus acetylated
DDPKLYDKDLGSAVGDTVVGQVDAATSL

SEQ ID NO: 2058 - protein, 28 aa, Artificial Sequence
  Description of Artificial Sequence: Synthetic peptide
  N-terminus acetylated
  C-terminus amidated
DDPKLYDKDLGSAVGDTVVGQLDAAWSL

SEQ ID NO: 2059 - protein, 28 aa, Artificial Sequence
  Description of Artificial Sequence: Synthetic peptide
  N-terminus acetylated
DDPKLYDKDLGSAVGDTVVGQLDAAWSL

SEQ ID NO: 2060 - protein, 28 aa, Artificial Sequence
  Description of Artificial Sequence: Synthetic peptide
  N-terminus acetylated
  C-terminus amidated
DDPKLYDKDLGSAVGDTVVGQLDAATSL

SEQ ID NO: 2061 - protein, 28 aa, Artificial Sequence
  Description of Artificial Sequence: Synthetic peptide
  N-terminus acetylated
DDPKLYDKDLGSAVGDTVVGQLDAATSL

SEQ ID NO: 2062 - protein, 28 aa, Artificial Sequence
  Description of Artificial Sequence: Synthetic peptide
  N-terminus acetylated
  C-terminus amidated
DDPKLYDKDLGSAVGDTVVGQMDAAWSL

SEQ ID NO: 2063 - protein, 28 aa, Artificial Sequence
  Description of Artificial Sequence: Synthetic peptide
  N-terminus acetylated
DDPKLYDKDLGSAVGDTVVGQMDAAWSL

SEQ ID NO: 2064 - protein, 28 aa, Artificial Sequence
  Description of Artificial Sequence: Synthetic peptide
  N-terminus acetylated
  C-terminus amidated
DDPKLYDKDLGSAVGDTVVGQMDAATSL

SEQ ID NO: 2065 - protein, 28 aa, Artificial Sequence
  Description of Artificial Sequence: Synthetic peptide
  N-terminus acetylated
DDPKLYDKDLGSAVGDTVVGQMDAATSL

SEQ ID NO: 2066 - protein, 28 aa, Artificial Sequence
  Description of Artificial Sequence: Synthetic peptide
  N-terminus acetylated
  C-terminus amidated
DDPKLYDKDLGSALWDWVVAWVDAAWSL

SEQ ID NO: 2067 - protein, 28 aa, Artificial Sequence
  Description of Artificial Sequence: Synthetic peptide
  N-terminus acetylated
DDPKLYDKDLGSALWDWVVAWVDAAWSL

SEQ ID NO: 2068 - protein, 28 aa, Artificial Sequence
  Description of Artificial Sequence: Synthetic peptide
  N-terminus acetylated
  C-terminus amidated
DDPKLYDKDLGSALWDWVVAWVDAATSL

SEQ ID NO: 2069 - protein, 28 aa, Artificial Sequence
  Description of Artificial Sequence: Synthetic peptide
  N-terminus acetylated
DDPKLYDKDLGSALWDWVVAWVDAATSL

SEQ ID NO: 2070 - protein, 28 aa, Artificial Sequence
  Description of Artificial Sequence: Synthetic peptide
  N-terminus acetylated
  C-terminus amidated
DDPKLYDKDLGSALWDWVVAWLDAAWSL

SEQ ID NO: 2071 - protein, 28 aa, Artificial Sequence
  Description of Artificial Sequence: Synthetic peptide
  N-terminus acetylated
DDPKLYDKDLGSALWDWVVAWLDAAWSL

SEQ ID NO: 2072 - protein, 28 aa, Artificial Sequence
  Description of Artificial Sequence: Synthetic peptide
  N-terminus acetylated
  C-terminus amidated
DDPKLYDKDLGSALWDWVVAWLDAATSL

SEQ ID NO: 2073 - protein, 28 aa, Artificial Sequence
  Description of Artificial Sequence: Synthetic peptide
  N-terminus acetylated
DDPKLYDKDLGSALWDWVVAWLDAATSL

SEQ ID NO: 2074 - protein, 28 aa, Artificial Sequence
  Description of Artificial Sequence: Synthetic peptide
  N-terminus acetylated
  C-terminus amidated
DDPKLYDKDLGSALWDWVVAWMDAAWSL

SEQ ID NO: 2075 - protein, 28 aa, Artificial Sequence
  Description of Artificial Sequence: Synthetic peptide
  N-terminus acetylated
DDPKLYDKDLGSALWDWVVAWMDAAWSL

SEQ ID NO: 2076 - protein, 28 aa, Artificial Sequence
  Description of Artificial Sequence: Synthetic peptide
  N-terminus acetylated
  C-terminus amidated
DDPKLYDKDLGSALWDWVVAWMDAATSL

SEQ ID NO: 2077 - protein, 28 aa, Artificial Sequence
  Description of Artificial Sequence: Synthetic peptide
  N-terminus acetylated
DDPKLYDKDLGSALWDWVVAWMDAATSL

SEQ ID NO: 2078 - protein, 28 aa, Artificial Sequence
  Description of Artificial Sequence: Synthetic peptide
  N-terminus acetylated
  C-terminus amidated
DDPKLYDKDLGSALWDWVVAQVDAAWSL

SEQ ID NO: 2079 - protein, 28 aa, Artificial Sequence
  Description of Artificial Sequence: Synthetic peptide
  N-terminus acetylated
DDPKLYDKDLGSALWDWVVAQVDAAWSL

SEQ ID NO: 2080 - protein, 28 aa, Artificial Sequence
  Description of Artificial Sequence: Synthetic peptide
  N-terminus acetylated
  C-terminus amidated
DDPKLYDKDLGSALWDWVVAQVDAATSL

SEQ ID NO: 2081 - protein, 28 aa, Artificial Sequence
  Description of Artificial Sequence: Synthetic peptide
  N-terminus acetylated
DDPKLYDKDLGSALWDWVVAQVDAATSL

SEQ ID NO: 2082 - protein, 28 aa, Artificial Sequence
  Description of Artificial Sequence: Synthetic peptide
  N-terminus acetylated
  C-terminus amidated
DDPKLYDKDLGSALWDWVVAQLDAAWSL

SEQ ID NO: 2083 - protein, 28 aa, Artificial Sequence
  Description of Artificial Sequence: Synthetic peptide
  N-terminus acetylated
DDPKLYDKDLGSALWDWVVAQLDAAWSL

SEQ ID NO: 2084 - protein, 28 aa, Artificial Sequence
  Description of Artificial Sequence: Synthetic peptide
  N-terminus acetylated
  C-terminus amidated
DDPKLYDKDLGSALWDWVVAQLDAATSL

SEQ ID NO: 2085 - protein, 28 aa, Artificial Sequence
  Description of Artificial Sequence: Synthetic peptide
  N-terminus acetylated
DDPKLYDKDLGSALWDWVVAQLDAATSL

SEQ ID NO: 2086 - protein, 28 aa, Artificial Sequence
  Description of Artificial Sequence: Synthetic peptide
  N-terminus acetylated
  C-terminus amidated
DDPKLYDKDLGSALWDWVVAQMDAAWSL

SEQ ID NO: 2087 - protein, 28 aa, Artificial Sequence
  Description of Artificial Sequence: Synthetic peptide
  N-terminus acetylated
DDPKLYDKDLGSALWDWVVAQMDAAWSL

SEQ ID NO: 2088 - protein, 28 aa, Artificial Sequence
  Description of Artificial Sequence: Synthetic peptide
  N-terminus acetylated
  C-terminus amidated
DDPKLYDKDLGSALWDWVVAQMDAATSL

SEQ ID NO: 2089 - protein, 28 aa, Artificial Sequence
  Description of Artificial Sequence: Synthetic peptide
  N-terminus acetylated
DDPKLYDKDLGSALWDWVVAQMDAATSL

SEQ ID NO: 2090 - protein, 28 aa, Artificial Sequence
  Description of Artificial Sequence: Synthetic peptide
  N-terminus acetylated
  C-terminus amidated
DDPKLYDKDLGSALWDWVVGWVDAAWSL

SEQ ID NO: 2091 - protein, 28 aa, Artificial Sequence
  Description of Artificial Sequence: Synthetic peptide
  N-terminus acetylated
DDPKLYDKDLGSALWDWVVGWVDAAWSL

SEQ ID NO: 2092 - protein, 28 aa, Artificial Sequence
  Description of Artificial Sequence: Synthetic peptide
  N-terminus acetylated
  C-terminus amidated
DDPKLYDKDLGSALWDWVVGWVDAATSL

SEQ ID NO: 2093 - protein, 28 aa, Artificial Sequence
  Description of Artificial Sequence: Synthetic peptide
  N-terminus acetylated
DDPKLYDKDLGSALWDWVVGWVDAATSL

SEQ ID NO: 2094 - protein, 28 aa, Artificial Sequence
  Description of Artificial Sequence: Synthetic peptide
  N-terminus acetylated
  C-terminus amidated
DDPKLYDKDLGSALWDWVVGWLDAAWSL

SEQ ID NO: 2095 - protein, 28 aa, Artificial Sequence
  Description of Artificial Sequence: Synthetic peptide
  N-terminus acetylated
DDPKLYDKDLGSALWDWVVGWLDAAWSL

SEQ ID NO: 2096 - protein, 28 aa, Artificial Sequence
  Description of Artificial Sequence: Synthetic peptide
  N-terminus acetylated
  C-terminus amidated
DDPKLYDKDLGSALWDWVVGWLDAATSL

SEQ ID NO: 2097 - protein, 28 aa, Artificial Sequence
  Description of Artificial Sequence: Synthetic peptide
  N-terminus acetylated
DDPKLYDKDLGSALWDWVVGWLDAATSL

SEQ ID NO: 2098 - protein, 28 aa, Artificial Sequence
  Description of Artificial Sequence: Synthetic peptide
  N-terminus acetylated
  C-terminus amidated
DDPKLYDKDLGSALWDWVVGWMDAAWSL

SEQ ID NO: 2099 - protein, 28 aa, Artificial Sequence
  Description of Artificial Sequence: Synthetic peptide
  N-terminus acetylated
DDPKLYDKDLGSALWDWVVGWMDAAWSL

SEQ ID NO: 2100 - protein, 28 aa, Artificial Sequence
  Description of Artificial Sequence: Synthetic peptide
  N-terminus acetylated
  C-terminus amidated
DDPKLYDKDLGSALWDWVVGWMDAATSL

SEQ ID NO: 2101 - protein, 28 aa, Artificial Sequence
  Description of Artificial Sequence: Synthetic peptide
  N-terminus acetylated
DDPKLYDKDLGSALWDWVVGWMDAATSL

SEQ ID NO: 2102 - protein, 28 aa, Artificial Sequence
  Description of Artificial Sequence: Synthetic peptide
  N-terminus acetylated
  C-terminus amidated
DDPKLYDKDLGSALWDWVVGQVDAAWSL

SEQ ID NO: 2103 - protein, 28 aa, Artificial Sequence
  Description of Artificial Sequence: Synthetic peptide
  N-terminus acetylated
DDPKLYDKDLGSALWDWVVGQVDAAWSL

SEQ ID NO: 2104 - protein, 28 aa, Artificial Sequence
  Description of Artificial Sequence: Synthetic peptide
  N-terminus acetylated
  C-terminus amidated
DDPKLYDKDLGSALWDWVVGQVDAATSL

SEQ ID NO: 2105 - protein, 28 aa, Artificial Sequence
  Description of Artificial Sequence: Synthetic peptide
  N-terminus acetylated
DDPKLYDKDLGSALWDWVVGQVDAATSL

SEQ ID NO: 2106 - protein, 28 aa, Artificial Sequence
  Description of Artificial Sequence: Synthetic peptide
  N-terminus acetylated
  C-terminus amidated
DDPKLYDKDLGSALWDWVVGQLDAAWSL

SEQ ID NO: 2107 - protein, 28 aa, Artificial Sequence
  Description of Artificial Sequence: Synthetic peptide
  N-terminus acetylated
DDPKLYDKDLGSALWDWVVGQLDAAWSL

SEQ ID NO: 2108 - protein, 28 aa, Artificial Sequence
  Description of Artificial Sequence: Synthetic peptide
  N-terminus acetylated
  C-terminus amidated
DDPKLYDKDLGSALWDWVVGQLDAATSL

SEQ ID NO: 2109 - protein, 28 aa, Artificial Sequence
  Description of Artificial Sequence: Synthetic peptide
  N-terminus acetylated
DDPKLYDKDLGSALWDWVVGQLDAATSL

SEQ ID NO: 2110 - protein, 28 aa, Artificial Sequence
  Description of Artificial Sequence: Synthetic peptide
  N-terminus acetylated
  C-terminus amidated
DDPKLYDKDLGSALWDWVVGQMDAAWSL

SEQ ID NO: 2111 - protein, 28 aa, Artificial Sequence
  Description of Artificial Sequence: Synthetic peptide
  N-terminus acetylated
DDPKLYDKDLGSALWDWVVGQMDAAWSL

SEQ ID NO: 2112 - protein, 28 aa, Artificial Sequence
  Description of Artificial Sequence: Synthetic peptide
  N-terminus acetylated
  C-terminus amidated
DDPKLYDKDLGSALWDWVVGQMDAATSL

SEQ ID NO: 2113 - protein, 28 aa, Artificial Sequence
  Description of Artificial Sequence: Synthetic peptide
  N-terminus acetylated
DDPKLYDKDLGSALWDWVVGQMDAATSL

SEQ ID NO: 2114 - protein, 28 aa, Artificial Sequence
  Description of Artificial Sequence: Synthetic peptide
  N-terminus acetylated
  C-terminus amidated
DDPKLYDKDLGSALWDTVVAWVDAAWSL

SEQ ID NO: 2115 - protein, 28 aa, Artificial Sequence
  Description of Artificial Sequence: Synthetic peptide
  N-terminus acetylated
DDPKLYDKDLGSALWDTVVAWVDAAWSL

SEQ ID NO: 2116 - protein, 28 aa, Artificial Sequence
  Description of Artificial Sequence: Synthetic peptide
  N-terminus acetylated
  C-terminus amidated
DDPKLYDKDLGSALWDTVVAWVDAATSL

SEQ ID NO: 2117 - protein, 28 aa, Artificial Sequence
  Description of Artificial Sequence: Synthetic peptide
  N-terminus acetylated
DDPKLYDKDLGSALWDTVVAWVDAATSL

SEQ ID NO: 2118 - protein, 28 aa, Artificial Sequence
  Description of Artificial Sequence: Synthetic peptide
  N-terminus acetylated
  C-terminus amidated
DDPKLYDKDLGSALWDTVVAWLDAAWSL

SEQ ID NO: 2119 - protein, 28 aa, Artificial Sequence
  Description of Artificial Sequence: Synthetic peptide
  N-terminus acetylated
DDPKLYDKDLGSALWDTVVAWLDAAWSL

SEQ ID NO: 2120 - protein, 28 aa, Artificial Sequence
  Description of Artificial Sequence: Synthetic peptide
  N-terminus acetylated
  C-terminus amidated
DDPKLYDKDLGSALWDTVVAWLDAATSL

SEQ ID NO: 2121 - protein, 28 aa, Artificial Sequence
  Description of Artificial Sequence: Synthetic peptide
  N-terminus acetylated
DDPKLYDKDLGSALWDTVVAWLDAATSL

SEQ ID NO: 2122 - protein, 28 aa, Artificial Sequence
  Description of Artificial Sequence: Synthetic peptide
  N-terminus acetylated
  C-terminus amidated
DDPKLYDKDLGSALWDTVVAWMDAAWSL

SEQ ID NO: 2123 - protein, 28 aa, Artificial Sequence
  Description of Artificial Sequence: Synthetic peptide
  N-terminus acetylated
DDPKLYDKDLGSALWDTVVAWMDAAWSL

SEQ ID NO: 2124 - protein, 28 aa, Artificial Sequence
  Description of Artificial Sequence: Synthetic peptide
  N-terminus acetylated
  C-terminus amidated
DDPKLYDKDLGSALWDTVVAWMDAATSL

SEQ ID NO: 2125 - protein, 28 aa, Artificial Sequence
  Description of Artificial Sequence: Synthetic peptide
  N-terminus acetylated
DDPKLYDKDLGSALWDTVVAWMDAATSL

SEQ ID NO: 2126 - protein, 28 aa, Artificial Sequence
  Description of Artificial Sequence: Synthetic peptide
  N-terminus acetylated
  C-terminus amidated
DDPKLYDKDLGSALWDTVVAQVDAAWSL

SEQ ID NO: 2127 - protein, 28 aa, Artificial Sequence
  Description of Artificial Sequence: Synthetic peptide
  N-terminus acetylated
DDPKLYDKDLGSALWDTVVAQVDAAWSL

SEQ ID NO: 2128 - protein, 28 aa, Artificial Sequence
  Description of Artificial Sequence: Synthetic peptide
  N-terminus acetylated
  C-terminus amidated
DDPKLYDKDLGSALWDTVVAQVDAATSL

SEQ ID NO: 2129 - protein, 28 aa, Artificial Sequence
  Description of Artificial Sequence: Synthetic peptide
  N-terminus acetylated
DDPKLYDKDLGSALWDTVVAQVDAATSL

SEQ ID NO: 2130 - protein, 28 aa, Artificial Sequence
  Description of Artificial Sequence: Synthetic peptide
  N-terminus acetylated
  C-terminus amidated
DDPKLYDKDLGSALWDTVVAQLDAAWSL

SEQ ID NO: 2131 - protein, 28 aa, Artificial Sequence
  Description of Artificial Sequence: Synthetic peptide
  N-terminus acetylated
DDPKLYDKDLGSALWDTVVAQLDAAWSL

SEQ ID NO: 2132 - protein, 28 aa, Artificial Sequence
  Description of Artificial Sequence: Synthetic peptide
  N-terminus acetylated
  C-terminus amidated
DDPKLYDKDLGSALWDTVVAQLDAATSL

SEQ ID NO: 2133 - protein, 28 aa, Artificial Sequence
  Description of Artificial Sequence: Synthetic peptide
  N-terminus acetylated
DDPKLYDKDLGSALWDTVVAQLDAATSL

SEQ ID NO: 2134 - protein, 28 aa, Artificial Sequence
  Description of Artificial Sequence: Synthetic peptide
  N-terminus acetylated
  C-terminus amidated
DDPKLYDKDLGSALWDTVVAQMDAAWSL

SEQ ID NO: 2135 - protein, 28 aa, Artificial Sequence
  Description of Artificial Sequence: Synthetic peptide
  N-terminus acetylated
DDPKLYDKDLGSALWDTVVAQMDAAWSL

SEQ ID NO: 2136 - protein, 28 aa, Artificial Sequence
  Description of Artificial Sequence: Synthetic peptide
  N-terminus acetylated
  C-terminus amidated
DDPKLYDKDLGSALWDTVVAQMDAATSL

SEQ ID NO: 2137 - protein, 28 aa, Artificial Sequence
  Description of Artificial Sequence: Synthetic peptide
  N-terminus acetylated
DDPKLYDKDLGSALWDTVVAQMDAATSL

SEQ ID NO: 2138 - protein, 28 aa, Artificial Sequence
  Description of Artificial Sequence: Synthetic peptide
  N-terminus acetylated
  C-terminus amidated
DDPKLYDKDLGSALWDTVVGWVDAAWSL

SEQ ID NO: 2139 - protein, 28 aa, Artificial Sequence
  Description of Artificial Sequence: Synthetic peptide
  N-terminus acetylated
DDPKLYDKDLGSALWDTVVGWVDAAWSL

SEQ ID NO: 2140 - protein, 28 aa, Artificial Sequence
  Description of Artificial Sequence: Synthetic peptide
  N-terminus acetylated
  C-terminus amidated
DDPKLYDKDLGSALWDTVVGWVDAATSL

SEQ ID NO: 2141 - protein, 28 aa, Artificial Sequence
  Description of Artificial Sequence: Synthetic peptide
  N-terminus acetylated
DDPKLYDKDLGSALWDTVVGWVDAATSL

SEQ ID NO: 2142 - protein, 28 aa, Artificial Sequence
  Description of Artificial Sequence: Synthetic peptide
  N-terminus acetylated
  C-terminus amidated
DDPKLYDKDLGSALWDTVVGWLDAAWSL

SEQ ID NO: 2143 - protein, 28 aa, Artificial Sequence
  Description of Artificial Sequence: Synthetic peptide
  N-terminus acetylated
DDPKLYDKDLGSALWDTVVGWLDAAWSL

SEQ ID NO: 2144 - protein, 28 aa, Artificial Sequence
  Description of Artificial Sequence: Synthetic peptide
  N-terminus acetylated
  C-terminus amidated
DDPKLYDKDLGSALWDTVVGWLDAATSL

SEQ ID NO: 2145 - protein, 28 aa, Artificial Sequence
  Description of Artificial Sequence: Synthetic peptide
  N-terminus acetylated
DDPKLYDKDLGSALWDTVVGWLDAATSL

SEQ ID NO: 2146 - protein, 28 aa, Artificial Sequence
  Description of Artificial Sequence: Synthetic peptide
  N-terminus acetylated
  C-terminus amidated
DDPKLYDKDLGSALWDTVVGWMDAAWSL

SEQ ID NO: 2147 - protein, 28 aa, Artificial Sequence
  Description of Artificial Sequence: Synthetic peptide
  N-terminus acetylated
DDPKLYDKDLGSALWDTVVGWMDAAWSL

SEQ ID NO: 2148 - protein, 28 aa, Artificial Sequence
  Description of Artificial Sequence: Synthetic peptide
  N-terminus acetylated
  C-terminus amidated
DDPKLYDKDLGSALWDTVVGWMDAATSL

SEQ ID NO: 2149 - protein, 28 aa, Artificial Sequence
  Description of Artificial Sequence: Synthetic peptide
  N-terminus acetylated
DDPKLYDKDLGSALWDTVVGWMDAATSL

SEQ ID NO: 2150 - protein, 28 aa, Artificial Sequence
  Description of Artificial Sequence: Synthetic peptide
  N-terminus acetylated
  C-terminus amidated
DDPKLYDKDLGSALWDTVVGQVDAAWSL

SEQ ID NO: 2151 - protein, 28 aa, Artificial Sequence
  Description of Artificial Sequence: Synthetic peptide
  N-terminus acetylated
DDPKLYDKDLGSALWDTVVGQVDAAWSL

SEQ ID NO: 2152 - protein, 28 aa, Artificial Sequence
  Description of Artificial Sequence: Synthetic peptide
  N-terminus acetylated
  C-terminus amidated
DDPKLYDKDLGSALWDTVVGQVDAATSL

SEQ ID NO: 2153 - protein, 28 aa, Artificial Sequence
  Description of Artificial Sequence: Synthetic peptide
  N-terminus acetylated
DDPKLYDKDLGSALWDTVVGQVDAATSL

SEQ ID NO: 2154 - protein, 28 aa, Artificial Sequence
  Description of Artificial Sequence: Synthetic peptide
  N-terminus acetylated
  C-terminus amidated
DDPKLYDKDLGSALWDTVVGQLDAAWSL

SEQ ID NO: 2155 - protein, 28 aa, Artificial Sequence
  Description of Artificial Sequence: Synthetic peptide
  N-terminus acetylated
DDPKLYDKDLGSALWDTVVGQLDAAWSL

SEQ ID NO: 2156 - protein, 28 aa, Artificial Sequence
  Description of Artificial Sequence: Synthetic peptide
  N-terminus acetylated
  C-terminus amidated
DDPKLYDKDLGSALWDTVVGQLDAATSL

SEQ ID NO: 2157 - protein, 28 aa, Artificial Sequence
  Description of Artificial Sequence: Synthetic peptide
  N-terminus acetylated
DDPKLYDKDLGSALWDTVVGQLDAATSL

SEQ ID NO: 2158 - protein, 28 aa, Artificial Sequence
  Description of Artificial Sequence: Synthetic peptide
  N-terminus acetylated
  C-terminus amidated
DDPKLYDKDLGSALWDTVVGQMDAAWSL

SEQ ID NO: 2159 - protein, 28 aa, Artificial Sequence
  Description of Artificial Sequence: Synthetic peptide
  N-terminus acetylated
DDPKLYDKDLGSALWDTVVGQMDAAWSL

SEQ ID NO: 2160 - protein, 28 aa, Artificial Sequence
  Description of Artificial Sequence: Synthetic peptide
  N-terminus acetylated
  C-terminus amidated
DDPKLYDKDLGSALWDTVVGQMDAATSL

SEQ ID NO: 2161 - protein, 28 aa, Artificial Sequence
  Description of Artificial Sequence: Synthetic peptide
  N-terminus acetylated
DDPKLYDKDLGSALWDTVVGQMDAATSL

SEQ ID NO: 2162 - protein, 28 aa, Artificial Sequence
  Description of Artificial Sequence: Synthetic peptide
  N-terminus acetylated
  C-terminus amidated
DDPKLYDKDLGSALTDWVVAWVDAAWSL

SEQ ID NO: 2163 - protein, 28 aa, Artificial Sequence
  Description of Artificial Sequence: Synthetic peptide
  N-terminus acetylated
DDPKLYDKDLGSALTDWVVAWVDAAWSL

SEQ ID NO: 2164 - protein, 28 aa, Artificial Sequence
  Description of Artificial Sequence: Synthetic peptide
  N-terminus acetylated
  C-terminus amidated
DDPKLYDKDLGSALTDWVVAWVDAATSL

SEQ ID NO: 2165 - protein, 28 aa, Artificial Sequence
  Description of Artificial Sequence: Synthetic peptide
  N-terminus acetylated
DDPKLYDKDLGSALTDWVVAWVDAATSL

SEQ ID NO: 2166 - protein, 28 aa, Artificial Sequence
  Description of Artificial Sequence: Synthetic peptide
  N-terminus acetylated
  C-terminus amidated
DDPKLYDKDLGSALTDWVVAWLDAAWSL

SEQ ID NO: 2167 - protein, 28 aa, Artificial Sequence
  Description of Artificial Sequence: Synthetic peptide
  N-terminus acetylated
DDPKLYDKDLGSALTDWVVAWLDAAWSL

SEQ ID NO: 2168 - protein, 28 aa, Artificial Sequence
  Description of Artificial Sequence: Synthetic peptide
  N-terminus acetylated
  C-terminus amidated
DDPKLYDKDLGSALTDWVVAWLDAATSL

SEQ ID NO: 2169 - protein, 28 aa, Artificial Sequence
  Description of Artificial Sequence: Synthetic peptide
  N-terminus acetylated
DDPKLYDKDLGSALTDWVVAWLDAATSL

SEQ ID NO: 2170 - protein, 28 aa, Artificial Sequence
  Description of Artificial Sequence: Synthetic peptide
  N-terminus acetylated
  C-terminus amidated
DDPKLYDKDLGSALTDWVVAWMDAAWSL

SEQ ID NO: 2171 - protein, 28 aa, Artificial Sequence
  Description of Artificial Sequence: Synthetic peptide
  N-terminus acetylated
DDPKLYDKDLGSALTDWVVAWMDAAWSL

SEQ ID NO: 2172 - protein, 28 aa, Artificial Sequence
  Description of Artificial Sequence: Synthetic peptide
  N-terminus acetylated
  C-terminus amidated
DDPKLYDKDLGSALTDWVVAWMDAATSL

SEQ ID NO: 2173 - protein, 28 aa, Artificial Sequence
  Description of Artificial Sequence: Synthetic peptide
  N-terminus acetylated
DDPKLYDKDLGSALTDWVVAWMDAATSL

SEQ ID NO: 2174 - protein, 28 aa, Artificial Sequence
  Description of Artificial Sequence: Synthetic peptide
  N-terminus acetylated
  C-terminus amidated
DDPKLYDKDLGSALTDWVVAQVDAAWSL

SEQ ID NO: 2175 - protein, 28 aa, Artificial Sequence
  Description of Artificial Sequence: Synthetic peptide
  N-terminus acetylated
DDPKLYDKDLGSALTDWVVAQVDAAWSL

SEQ ID NO: 2176 - protein, 28 aa, Artificial Sequence
  Description of Artificial Sequence: Synthetic peptide
  N-terminus acetylated
  C-terminus amidated
DDPKLYDKDLGSALTDWVVAQVDAATSL

SEQ ID NO: 2177 - protein, 28 aa, Artificial Sequence
  Description of Artificial Sequence: Synthetic peptide
  N-terminus acetylated
DDPKLYDKDLGSALTDWVVAQVDAATSL

SEQ ID NO: 2178 - protein, 28 aa, Artificial Sequence
  Description of Artificial Sequence: Synthetic peptide
  N-terminus acetylated
  C-terminus amidated
DDPKLYDKDLGSALTDWVVAQLDAAWSL

SEQ ID NO: 2179 - protein, 28 aa, Artificial Sequence
  Description of Artificial Sequence: Synthetic peptide
  N-terminus acetylated
DDPKLYDKDLGSALTDWVVAQLDAAWSL

SEQ ID NO: 2180 - protein, 28 aa, Artificial Sequence
  Description of Artificial Sequence: Synthetic peptide
  N-terminus acetylated
  C-terminus amidated
DDPKLYDKDLGSALTDWVVAQLDAATSL

SEQ ID NO: 2181 - protein, 28 aa, Artificial Sequence
  Description of Artificial Sequence: Synthetic peptide
  N-terminus acetylated
DDPKLYDKDLGSALTDWVVAQLDAATSL

SEQ ID NO: 2182 - protein, 28 aa, Artificial Sequence
  Description of Artificial Sequence: Synthetic peptide
  N-terminus acetylated
  C-terminus amidated
DDPKLYDKDLGSALTDWVVAQMDAAWSL

SEQ ID NO: 2183 - protein, 28 aa, Artificial Sequence
  Description of Artificial Sequence: Synthetic peptide
  N-terminus acetylated
DDPKLYDKDLGSALTDWVVAQMDAAWSL

SEQ ID NO: 2184 - protein, 28 aa, Artificial Sequence
  Description of Artificial Sequence: Synthetic peptide
  N-terminus acetylated
  C-terminus amidated
DDPKLYDKDLGSALTDWVVAQMDAATSL

SEQ ID NO: 2185 - protein, 28 aa, Artificial Sequence
  Description of Artificial Sequence: Synthetic peptide
  N-terminus acetylated
DDPKLYDKDLGSALTDWVVAQMDAATSL

SEQ ID NO: 2186 - protein, 28 aa, Artificial Sequence
  Description of Artificial Sequence: Synthetic peptide
  N-terminus acetylated
  C-terminus amidated
DDPKLYDKDLGSALTDWVVGWVDAAWSL

SEQ ID NO: 2187 - protein, 28 aa, Artificial Sequence
  Description of Artificial Sequence: Synthetic peptide
  N-terminus acetylated
DDPKLYDKDLGSALTDWVVGWVDAAWSL

SEQ ID NO: 2188 - protein, 28 aa, Artificial Sequence
  Description of Artificial Sequence: Synthetic peptide
  N-terminus acetylated
  C-terminus amidated
DDPKLYDKDLGSALTDWVVGWVDAATSL

SEQ ID NO: 2189 - protein, 28 aa, Artificial Sequence
  Description of Artificial Sequence: Synthetic peptide
  N-terminus acetylated
DDPKLYDKDLGSALTDWVVGWVDAATSL

SEQ ID NO: 2190 - protein, 28 aa, Artificial Sequence
  Description of Artificial Sequence: Synthetic peptide
  N-terminus acetylated
  C-terminus amidated
DDPKLYDKDLGSALTDWVVGWLDAAWSL

SEQ ID NO: 2191 - protein, 28 aa, Artificial Sequence
  Description of Artificial Sequence: Synthetic peptide
  N-terminus acetylated
DDPKLYDKDLGSALTDWVVGWLDAAWSL

SEQ ID NO: 2192 - protein, 28 aa, Artificial Sequence
  Description of Artificial Sequence: Synthetic peptide
  N-terminus acetylated
  C-terminus amidated
DDPKLYDKDLGSALTDWVVGWLDAATSL

SEQ ID NO: 2193 - protein, 28 aa, Artificial Sequence
  Description of Artificial Sequence: Synthetic peptide
  N-terminus acetylated
DDPKLYDKDLGSALTDWVVGWLDAATSL

SEQ ID NO: 2194 - protein, 28 aa, Artificial Sequence
  Description of Artificial Sequence: Synthetic peptide
  N-terminus acetylated
  C-terminus amidated
DDPKLYDKDLGSALTDWVVGWMDAAWSL

SEQ ID NO: 2195 - protein, 28 aa, Artificial Sequence
  Description of Artificial Sequence: Synthetic peptide
  N-terminus acetylated
DDPKLYDKDLGSALTDWVVGWMDAAWSL

SEQ ID NO: 2196 - protein, 28 aa, Artificial Sequence
  Description of Artificial Sequence: Synthetic peptide
  N-terminus acetylated
  C-terminus amidated
DDPKLYDKDLGSALTDWVVGWMDAATSL

SEQ ID NO: 2197 - protein, 28 aa, Artificial Sequence
  Description of Artificial Sequence: Synthetic peptide
  N-terminus acetylated
DDPKLYDKDLGSALTDWVVGWMDAATSL

SEQ ID NO: 2198 - protein, 28 aa, Artificial Sequence
  Description of Artificial Sequence: Synthetic peptide
  N-terminus acetylated
  C-terminus amidated
DDPKLYDKDLGSALTDWVVGQVDAAWSL

SEQ ID NO: 2199 - protein, 28 aa, Artificial Sequence
  Description of Artificial Sequence: Synthetic peptide
  N-terminus acetylated
DDPKLYDKDLGSALTDWVVGQVDAAWSL

SEQ ID NO: 2200 - protein, 28 aa, Artificial Sequence
  Description of Artificial Sequence: Synthetic peptide
  N-terminus acetylated
  C-terminus amidated
DDPKLYDKDLGSALTDWVVGQVDAATSL

SEQ ID NO: 2201 - protein, 28 aa, Artificial Sequence
  Description of Artificial Sequence: Synthetic peptide
  N-terminus acetylated
DDPKLYDKDLGSALTDWVVGQVDAATSL

SEQ ID NO: 2202 - protein, 28 aa, Artificial Sequence
  Description of Artificial Sequence: Synthetic peptide
  N-terminus acetylated
  C-terminus amidated
DDPKLYDKDLGSALTDWVVGQLDAAWSL

SEQ ID NO: 2203 - protein, 28 aa, Artificial Sequence
  Description of Artificial Sequence: Synthetic peptide
  N-terminus acetylated
DDPKLYDKDLGSALTDWVVGQLDAAWSL

SEQ ID NO: 2204 - protein, 28 aa, Artificial Sequence
  Description of Artificial Sequence: Synthetic peptide
  N-terminus acetylated
  C-terminus amidated
DDPKLYDKDLGSALTDWVVGQLDAATSL

SEQ ID NO: 2205 - protein, 28 aa, Artificial Sequence
  Description of Artificial Sequence: Synthetic peptide
  N-terminus acetylated
DDPKLYDKDLGSALTDWVVGQLDAATSL

SEQ ID NO: 2206 - protein, 28 aa, Artificial Sequence
  Description of Artificial Sequence: Synthetic peptide
  N-terminus acetylated
  C-terminus amidated
DDPKLYDKDLGSALTDWVVGQMDAAWSL

SEQ ID NO: 2207 - protein, 28 aa, Artificial Sequence
  Description of Artificial Sequence: Synthetic peptide
  N-terminus acetylated
DDPKLYDKDLGSALTDWVVGQMDAAWSL

SEQ ID NO: 2208 - protein, 28 aa, Artificial Sequence
  Description of Artificial Sequence: Synthetic peptide
  N-terminus acetylated
  C-terminus amidated
DDPKLYDKDLGSALTDWVVGQMDAATSL

SEQ ID NO: 2209 - protein, 28 aa, Artificial Sequence
  Description of Artificial Sequence: Synthetic peptide
  N-terminus acetylated
DDPKLYDKDLGSALTDWVVGQMDAATSL

SEQ ID NO: 2210 - protein, 28 aa, Artificial Sequence
  Description of Artificial Sequence: Synthetic peptide
  N-terminus acetylated
  C-terminus amidated
DDPKLYDKDLGSALTDTVVAWVDAAWSL

SEQ ID NO: 2211 - protein, 28 aa, Artificial Sequence
  Description of Artificial Sequence: Synthetic peptide
  N-terminus acetylated
DDPKLYDKDLGSALTDTVVAWVDAAWSL

SEQ ID NO: 2212 - protein, 28 aa, Artificial Sequence
  Description of Artificial Sequence: Synthetic peptide
  N-terminus acetylated
  C-terminus amidated
DDPKLYDKDLGSALTDTVVAWVDAATSL

SEQ ID NO: 2213 - protein, 28 aa, Artificial Sequence
  Description of Artificial Sequence: Synthetic peptide
  N-terminus acetylated
DDPKLYDKDLGSALTDTVVAWVDAATSL

SEQ ID NO: 2214 - protein, 28 aa, Artificial Sequence
  Description of Artificial Sequence: Synthetic peptide
  N-terminus acetylated
  C-terminus amidated
DDPKLYDKDLGSALTDTVVAWLDAAWSL

SEQ ID NO: 2215 - protein, 28 aa, Artificial Sequence
  Description of Artificial Sequence: Synthetic peptide
  N-terminus acetylated
DDPKLYDKDLGSALTDTVVAWLDAAWSL

SEQ ID NO: 2216 - protein, 28 aa, Artificial Sequence
  Description of Artificial Sequence: Synthetic peptide
  N-terminus acetylated
  C-terminus amidated
DDPKLYDKDLGSALTDTVVAWLDAATSL

SEQ ID NO: 2217 - protein, 28 aa, Artificial Sequence
  Description of Artificial Sequence: Synthetic peptide
  N-terminus acetylated
DDPKLYDKDLGSALTDTVVAWLDAATSL

SEQ ID NO: 2218 - protein, 28 aa, Artificial Sequence
  Description of Artificial Sequence: Synthetic peptide
  N-terminus acetylated
  C-terminus amidated
DDPKLYDKDLGSALTDTVVAWMDAAWSL

SEQ ID NO: 2219 - protein, 28 aa, Artificial Sequence
  Description of Artificial Sequence: Synthetic peptide
  N-terminus acetylated
DDPKLYDKDLGSALTDTVVAWMDAAWSL

SEQ ID NO: 2220 - protein, 28 aa, Artificial Sequence
  Description of Artificial Sequence: Synthetic peptide
  N-terminus acetylated
  C-terminus amidated
DDPKLYDKDLGSALTDTVVAWMDAATSL

SEQ ID NO: 2221 - protein, 28 aa, Artificial Sequence
  Description of Artificial Sequence: Synthetic peptide
  N-terminus acetylated
DDPKLYDKDLGSALTDTVVAWMDAATSL

SEQ ID NO: 2222 - protein, 28 aa, Artificial Sequence
  Description of Artificial Sequence: Synthetic peptide
  N-terminus acetylated
  C-terminus amidated
DDPKLYDKDLGSALTDTVVAQVDAAWSL

SEQ ID NO: 2223 - protein, 28 aa, Artificial Sequence
  Description of Artificial Sequence: Synthetic peptide
  N-terminus acetylated
DDPKLYDKDLGSALTDTVVAQVDAAWSL

SEQ ID NO: 2224 - protein, 28 aa, Artificial Sequence
  Description of Artificial Sequence: Synthetic peptide
  N-terminus acetylated
  C-terminus amidated
DDPKLYDKDLGSALTDTVVAQVDAATSL

SEQ ID NO: 2225 - protein, 28 aa, Artificial Sequence
  Description of Artificial Sequence: Synthetic peptide
  N-terminus acetylated
DDPKLYDKDLGSALTDTVVAQVDAATSL

SEQ ID NO: 2226 - protein, 28 aa, Artificial Sequence
  Description of Artificial Sequence: Synthetic peptide
  N-terminus acetylated
  C-terminus amidated
DDPKLYDKDLGSALTDTVVAQLDAAWSL

SEQ ID NO: 2227 - protein, 28 aa, Artificial Sequence
  Description of Artificial Sequence: Synthetic peptide
  N-terminus acetylated
DDPKLYDKDLGSALTDTVVAQLDAAWSL

SEQ ID NO: 2228 - protein, 28 aa, Artificial Sequence
  Description of Artificial Sequence: Synthetic peptide
  N-terminus acetylated
  C-terminus amidated
DDPKLYDKDLGSALTDTVVAQLDAATSL

SEQ ID NO: 2229 - protein, 28 aa, Artificial Sequence
  Description of Artificial Sequence: Synthetic peptide
  N-terminus acetylated
DDPKLYDKDLGSALTDTVVAQLDAATSL

SEQ ID NO: 2230 - protein, 28 aa, Artificial Sequence
  Description of Artificial Sequence: Synthetic peptide
  N-terminus acetylated
  C-terminus amidated
DDPKLYDKDLGSALTDTVVAQMDAAWSL

SEQ ID NO: 2231 - protein, 28 aa, Artificial Sequence
  Description of Artificial Sequence: Synthetic peptide
  N-terminus acetylated
DDPKLYDKDLGSALTDTVVAQMDAAWSL

SEQ ID NO: 2232 - protein, 28 aa, Artificial Sequence
  Description of Artificial Sequence: Synthetic peptide
  N-terminus acetylated
  C-terminus amidated
DDPKLYDKDLGSALTDTVVAQMDAATSL

SEQ ID NO: 2233 - protein, 28 aa, Artificial Sequence
  Description of Artificial Sequence: Synthetic peptide
  N-terminus acetylated
DDPKLYDKDLGSALTDTVVAQMDAATSL

SEQ ID NO: 2234 - protein, 28 aa, Artificial Sequence
  Description of Artificial Sequence: Synthetic peptide
  N-terminus acetylated
  C-terminus amidated
DDPKLYDKDLGSALTDTVVGWVDAAWSL

SEQ ID NO: 2235 - protein, 28 aa, Artificial Sequence
  Description of Artificial Sequence: Synthetic peptide
  N-terminus acetylated
DDPKLYDKDLGSALTDTVVGWVDAAWSL

SEQ ID NO: 2236 - protein, 28 aa, Artificial Sequence
  Description of Artificial Sequence: Synthetic peptide
  N-terminus acetylated
  C-terminus amidated
DDPKLYDKDLGSALTDTVVGWVDAATSL

SEQ ID NO: 2237 - protein, 28 aa, Artificial Sequence
  Description of Artificial Sequence: Synthetic peptide
  N-terminus acetylated
DDPKLYDKDLGSALTDTVVGWVDAATSL

SEQ ID NO: 2238 - protein, 28 aa, Artificial Sequence
  Description of Artificial Sequence: Synthetic peptide
  N-terminus acetylated
  C-terminus amidated
DDPKLYDKDLGSALTDTVVGWLDAAWSL

SEQ ID NO: 2239 - protein, 28 aa, Artificial Sequence
  Description of Artificial Sequence: Synthetic peptide
  N-terminus acetylated
DDPKLYDKDLGSALTDTVVGWLDAAWSL

SEQ ID NO: 2240 - protein, 28 aa, Artificial Sequence
  Description of Artificial Sequence: Synthetic peptide
  N-terminus acetylated
  C-terminus amidated
DDPKLYDKDLGSALTDTVVGWLDAATSL

SEQ ID NO: 2241 - protein, 28 aa, Artificial Sequence
  Description of Artificial Sequence: Synthetic peptide
  N-terminus acetylated
DDPKLYDKDLGSALTDTVVGWLDAATSL

SEQ ID NO: 2242 - protein, 28 aa, Artificial Sequence
  Description of Artificial Sequence: Synthetic peptide
  N-terminus acetylated
  C-terminus amidated
DDPKLYDKDLGSALTDTVVGWMDAAWSL

SEQ ID NO: 2243 - protein, 28 aa, Artificial Sequence
  Description of Artificial Sequence: Synthetic peptide
  N-terminus acetylated
DDPKLYDKDLGSALTDTVVGWMDAAWSL

SEQ ID NO: 2244 - protein, 28 aa, Artificial Sequence
  Description of Artificial Sequence: Synthetic peptide
  N-terminus acetylated
  C-terminus amidated
DDPKLYDKDLGSALTDTVVGWMDAATSL

SEQ ID NO: 2245 - protein, 28 aa, Artificial Sequence
  Description of Artificial Sequence: Synthetic peptide
  N-terminus acetylated
DDPKLYDKDLGSALTDTVVGWMDAATSL

SEQ ID NO: 2246 - protein, 28 aa, Artificial Sequence
  Description of Artificial Sequence: Synthetic peptide
  N-terminus acetylated
  C-terminus amidated
DDPKLYDKDLGSALTDTVVGQVDAAWSL

SEQ ID NO: 2247 - protein, 28 aa, Artificial Sequence
  Description of Artificial Sequence: Synthetic peptide
  N-terminus acetylated
DDPKLYDKDLGSALTDTVVGQVDAAWSL

SEQ ID NO: 2248 - protein, 28 aa, Artificial Sequence
  Description of Artificial Sequence: Synthetic peptide
  N-terminus acetylated
  C-terminus amidated
DDPKLYDKDLGSALTDTVVGQVDAATSL

SEQ ID NO: 2249 - protein, 28 aa, Artificial Sequence
  Description of Artificial Sequence: Synthetic peptide
  N-terminus acetylated
DDPKLYDKDLGSALTDTVVGQVDAATSL

SEQ ID NO: 2250 - protein, 28 aa, Artificial Sequence
  Description of Artificial Sequence: Synthetic peptide
  N-terminus acetylated
  C-terminus amidated
DDPKLYDKDLGSALTDTVVGQLDAAWSL

SEQ ID NO: 2251 - protein, 28 aa, Artificial Sequence
  Description of Artificial Sequence: Synthetic peptide
  N-terminus acetylated
DDPKLYDKDLGSALTDTVVGQLDAAWSL

SEQ ID NO: 2252 - protein, 28 aa, Artificial Sequence
  Description of Artificial Sequence: Synthetic peptide
  N-terminus acetylated
  C-terminus amidated
DDPKLYDKDLGSALTDTVVGQLDAATSL

SEQ ID NO: 2253 - protein, 28 aa, Artificial Sequence
  Description of Artificial Sequence: Synthetic peptide
  N-terminus acetylated
DDPKLYDKDLGSALTDTVVGQLDAATSL

SEQ ID NO: 2254 - protein, 28 aa, Artificial Sequence
  Description of Artificial Sequence: Synthetic peptide
  N-terminus acetylated
  C-terminus amidated
DDPKLYDKDLGSALTDTVVGQMDAAWSL

SEQ ID NO: 2255 - protein, 28 aa, Artificial Sequence
  Description of Artificial Sequence: Synthetic peptide
  N-terminus acetylated
DDPKLYDKDLGSALTDTVVGQMDAAWSL

SEQ ID NO: 2256 - protein, 28 aa, Artificial Sequence
  Description of Artificial Sequence: Synthetic peptide
  N-terminus acetylated
  C-terminus amidated
DDPKLYDKDLGSALTDTVVGQMDAATSL

SEQ ID NO: 2257 - protein, 28 aa, Artificial Sequence
  Description of Artificial Sequence: Synthetic peptide
  N-terminus acetylated
DDPKLYDKDLGSALTDTVVGQMDAATSL

SEQ ID NO: 2258 - protein, 28 aa, Artificial Sequence
  Description of Artificial Sequence: Synthetic peptide
  N-terminus acetylated
  C-terminus amidated
DDPKLYDKDLGSALGDWVVAWVDAAWSL

SEQ ID NO: 2259 - protein, 28 aa, Artificial Sequence
  Description of Artificial Sequence: Synthetic peptide
  N-terminus acetylated
DDPKLYDKDLGSALGDWVVAWVDAAWSL

SEQ ID NO: 2260 - protein, 28 aa, Artificial Sequence
  Description of Artificial Sequence: Synthetic peptide
  N-terminus acetylated
  C-terminus amidated
DDPKLYDKDLGSALGDWVVAWVDAATSL

SEQ ID NO: 2261 - protein, 28 aa, Artificial Sequence
  Description of Artificial Sequence: Synthetic peptide
  N-terminus acetylated
DDPKLYDKDLGSALGDWVVAWVDAATSL

SEQ ID NO: 2262 - protein, 28 aa, Artificial Sequence
  Description of Artificial Sequence: Synthetic peptide
  N-terminus acetylated
  C-terminus amidated
DDPKLYDKDLGSALGDWVVAWLDAAWSL

SEQ ID NO: 2263 - protein, 28 aa, Artificial Sequence
  Description of Artificial Sequence: Synthetic peptide
  N-terminus acetylated
DDPKLYDKDLGSALGDWVVAWLDAAWSL

SEQ ID NO: 2264 - protein, 28 aa, Artificial Sequence
  Description of Artificial Sequence: Synthetic peptide
  N-terminus acetylated
  C-terminus amidated
DDPKLYDKDLGSALGDWVVAWLDAATSL

SEQ ID NO: 2265 - protein, 28 aa, Artificial Sequence
  Description of Artificial Sequence: Synthetic peptide
  N-terminus acetylated
DDPKLYDKDLGSALGDWVVAWLDAATSL

SEQ ID NO: 2266 - protein, 28 aa, Artificial Sequence
  Description of Artificial Sequence: Synthetic peptide
  N-terminus acetylated
  C-terminus amidated
DDPKLYDKDLGSALGDWVVAWMDAAWSL

SEQ ID NO: 2267 - protein, 28 aa, Artificial Sequence
  Description of Artificial Sequence: Synthetic peptide
  N-terminus acetylated
DDPKLYDKDLGSALGDWVVAWMDAAWSL

SEQ ID NO: 2268 - protein, 28 aa, Artificial Sequence
  Description of Artificial Sequence: Synthetic peptide
  N-terminus acetylated
  C-terminus amidated
DDPKLYDKDLGSALGDWVVAWMDAATSL

SEQ ID NO: 2269 - protein, 28 aa, Artificial Sequence
  Description of Artificial Sequence: Synthetic peptide
  N-terminus acetylated
DDPKLYDKDLGSALGDWVVAWMDAATSL

SEQ ID NO: 2270 - protein, 28 aa, Artificial Sequence
  Description of Artificial Sequence: Synthetic peptide
  N-terminus acetylated
  C-terminus amidated
DDPKLYDKDLGSALGDWVVAQVDAAWSL

SEQ ID NO: 2271 - protein, 28 aa, Artificial Sequence
  Description of Artificial Sequence: Synthetic peptide
  N-terminus acetylated
DDPKLYDKDLGSALGDWVVAQVDAAWSL

SEQ ID NO: 2272 - protein, 28 aa, Artificial Sequence
  Description of Artificial Sequence: Synthetic peptide
  N-terminus acetylated
  C-terminus amidated
DDPKLYDKDLGSALGDWVVAQVDAATSL

SEQ ID NO: 2273 - protein, 28 aa, Artificial Sequence
  Description of Artificial Sequence: Synthetic peptide
  N-terminus acetylated
DDPKLYDKDLGSALGDWVVAQVDAATSL

SEQ ID NO: 2274 - protein, 28 aa, Artificial Sequence
  Description of Artificial Sequence: Synthetic peptide
  N-terminus acetylated
  C-terminus amidated
DDPKLYDKDLGSALGDWVVAQLDAAWSL

SEQ ID NO: 2275 - protein, 28 aa, Artificial Sequence
  Description of Artificial Sequence: Synthetic peptide
  N-terminus acetylated
DDPKLYDKDLGSALGDWVVAQLDAAWSL

SEQ ID NO: 2276 - protein, 28 aa, Artificial Sequence
  Description of Artificial Sequence: Synthetic peptide
  N-terminus acetylated
  C-terminus amidated
DDPKLYDKDLGSALGDWVVAQLDAATSL

SEQ ID NO: 2277 - protein, 28 aa, Artificial Sequence
  Description of Artificial Sequence: Synthetic peptide
  N-terminus acetylated
DDPKLYDKDLGSALGDWVVAQLDAATSL

SEQ ID NO: 2278 - protein, 28 aa, Artificial Sequence
  Description of Artificial Sequence: Synthetic peptide
  N-terminus acetylated
  C-terminus amidated
DDPKLYDKDLGSALGDWVVAQMDAAWSL

SEQ ID NO: 2279 - protein, 28 aa, Artificial Sequence
  Description of Artificial Sequence: Synthetic peptide
  N-terminus acetylated
DDPKLYDKDLGSALGDWVVAQMDAAWSL

SEQ ID NO: 2280 - protein, 28 aa, Artificial Sequence
  Description of Artificial Sequence: Synthetic peptide
  N-terminus acetylated
  C-terminus amidated
DDPKLYDKDLGSALGDWVVAQMDAATSL

SEQ ID NO: 2281 - protein, 28 aa, Artificial Sequence
  Description of Artificial Sequence: Synthetic peptide
  N-terminus acetylated
DDPKLYDKDLGSALGDWVVAQMDAATSL

SEQ ID NO: 2282 - protein, 28 aa, Artificial Sequence
  Description of Artificial Sequence: Synthetic peptide
  N-terminus acetylated
  C-terminus amidated
DDPKLYDKDLGSALGDWVVGWVDAAWSL

SEQ ID NO: 2283 - protein, 28 aa, Artificial Sequence
  Description of Artificial Sequence: Synthetic peptide
  N-terminus acetylated
DDPKLYDKDLGSALGDWVVGWVDAAWSL

SEQ ID NO: 2284 - protein, 28 aa, Artificial Sequence
  Description of Artificial Sequence: Synthetic peptide
  N-terminus acetylated
  C-terminus amidated
DDPKLYDKDLGSALGDWVVGWVDAATSL

SEQ ID NO: 2285 - protein, 28 aa, Artificial Sequence
  Description of Artificial Sequence: Synthetic peptide
  N-terminus acetylated
DDPKLYDKDLGSALGDWVVGWVDAATSL

SEQ ID NO: 2286 - protein, 28 aa, Artificial Sequence
  Description of Artificial Sequence: Synthetic peptide
  N-terminus acetylated
  C-terminus amidated
DDPKLYDKDLGSALGDWVVGWLDAAWSL

SEQ ID NO: 2287 - protein, 28 aa, Artificial Sequence
  Description of Artificial Sequence: Synthetic peptide
  N-terminus acetylated
DDPKLYDKDLGSALGDWVVGWLDAAWSL

SEQ ID NO: 2288 - protein, 28 aa, Artificial Sequence
  Description of Artificial Sequence: Synthetic peptide
  N-terminus acetylated
  C-terminus amidated
DDPKLYDKDLGSALGDWVVGWLDAATSL

SEQ ID NO: 2289 - protein, 28 aa, Artificial Sequence
  Description of Artificial Sequence: Synthetic peptide
  N-terminus acetylated
DDPKLYDKDLGSALGDWVVGWLDAATSL

SEQ ID NO: 2290 - protein, 28 aa, Artificial Sequence
  Description of Artificial Sequence: Synthetic peptide
  N-terminus acetylated
  C-terminus amidated
DDPKLYDKDLGSALGDWVVGWMDAAWSL

SEQ ID NO: 2291 - protein, 28 aa, Artificial Sequence
  Description of Artificial Sequence: Synthetic peptide
  N-terminus acetylated
DDPKLYDKDLGSALGDWVVGWMDAAWSL

SEQ ID NO: 2292 - protein, 28 aa, Artificial Sequence
  Description of Artificial Sequence: Synthetic peptide
  N-terminus acetylated
  C-terminus amidated
DDPKLYDKDLGSALGDWVVGWMDAATSL

SEQ ID NO: 2293 - protein, 28 aa, Artificial Sequence
  Description of Artificial Sequence: Synthetic peptide
  N-terminus acetylated
DDPKLYDKDLGSALGDWVVGWMDAATSL

SEQ ID NO: 2294 - protein, 28 aa, Artificial Sequence
  Description of Artificial Sequence: Synthetic peptide
  N-terminus acetylated
  C-terminus amidated
DDPKLYDKDLGSALGDWVVGQVDAAWSL

SEQ ID NO: 2295 - protein, 28 aa, Artificial Sequence
  Description of Artificial Sequence: Synthetic peptide
  N-terminus acetylated
DDPKLYDKDLGSALGDWVVGQVDAAWSL

SEQ ID NO: 2296 - protein, 28 aa, Artificial Sequence
  Description of Artificial Sequence: Synthetic peptide
  N-terminus acetylated
  C-terminus amidated
DDPKLYDKDLGSALGDWVVGQVDAATSL

SEQ ID NO: 2297 - protein, 28 aa, Artificial Sequence
  Description of Artificial Sequence: Synthetic peptide
  N-terminus acetylated
DDPKLYDKDLGSALGDWVVGQVDAATSL

SEQ ID NO: 2298 - protein, 28 aa, Artificial Sequence
  Description of Artificial Sequence: Synthetic peptide
  N-terminus acetylated
  C-terminus amidated
DDPKLYDKDLGSALGDWVVGQLDAAWSL

SEQ ID NO: 2299 - protein, 28 aa, Artificial Sequence
  Description of Artificial Sequence: Synthetic peptide
  N-terminus acetylated
DDPKLYDKDLGSALGDWVVGQLDAAWSL

SEQ ID NO: 2300 - protein, 28 aa, Artificial Sequence
  Description of Artificial Sequence: Synthetic peptide
  N-terminus acetylated
  C-terminus amidated
DDPKLYDKDLGSALGDWVVGQLDAATSL

SEQ ID NO: 2301 - protein, 28 aa, Artificial Sequence
  Description of Artificial Sequence: Synthetic peptide
  N-terminus acetylated
DDPKLYDKDLGSALGDWVVGQLDAATSL

SEQ ID NO: 2302 - protein, 28 aa, Artificial Sequence
  Description of Artificial Sequence: Synthetic peptide
  N-terminus acetylated
  C-terminus amidated
DDPKLYDKDLGSALGDWVVGQMDAAWSL

SEQ ID NO: 2303 - protein, 28 aa, Artificial Sequence
  Description of Artificial Sequence: Synthetic peptide
  N-terminus acetylated
DDPKLYDKDLGSALGDWVVGQMDAAWSL

SEQ ID NO: 2304 - protein, 28 aa, Artificial Sequence
  Description of Artificial Sequence: Synthetic peptide
  N-terminus acetylated
  C-terminus amidated
DDPKLYDKDLGSALGDWVVGQMDAATSL

SEQ ID NO: 2305 - protein, 28 aa, Artificial Sequence
  Description of Artificial Sequence: Synthetic peptide
  N-terminus acetylated
DDPKLYDKDLGSALGDWVVGQMDAATSL

SEQ ID NO: 2306 - protein, 28 aa, Artificial Sequence
  Description of Artificial Sequence: Synthetic peptide
  N-terminus acetylated
  C-terminus amidated
DDPKLYDKDLGSALGDTVVAWVDAAWSL

SEQ ID NO: 2307 - protein, 28 aa, Artificial Sequence
  Description of Artificial Sequence: Synthetic peptide
  N-terminus acetylated
DDPKLYDKDLGSALGDTVVAWVDAAWSL

SEQ ID NO: 2308 - protein, 28 aa, Artificial Sequence
  Description of Artificial Sequence: Synthetic peptide
  N-terminus acetylated
  C-terminus amidated
DDPKLYDKDLGSALGDTVVAWVDAATSL

SEQ ID NO: 2309 - protein, 28 aa, Artificial Sequence
  Description of Artificial Sequence: Synthetic peptide
  N-terminus acetylated
DDPKLYDKDLGSALGDTVVAWVDAATSL

SEQ ID NO: 2310 - protein, 28 aa, Artificial Sequence
  Description of Artificial Sequence: Synthetic peptide
  N-terminus acetylated
  C-terminus amidated
DDPKLYDKDLGSALGDTVVAWLDAAWSL

SEQ ID NO: 2311 - protein, 28 aa, Artificial Sequence
  Description of Artificial Sequence: Synthetic peptide
  N-terminus acetylated
DDPKLYDKDLGSALGDTVVAWLDAAWSL

SEQ ID NO: 2312 - protein, 28 aa, Artificial Sequence
  Description of Artificial Sequence: Synthetic peptide
  N-terminus acetylated
  C-terminus amidated
DDPKLYDKDLGSALGDTVVAWLDAATSL

SEQ ID NO: 2313 - protein, 28 aa, Artificial Sequence
  Description of Artificial Sequence: Synthetic peptide
  N-terminus acetylated
DDPKLYDKDLGSALGDTVVAWLDAATSL

SEQ ID NO: 2314 - protein, 28 aa, Artificial Sequence
  Description of Artificial Sequence: Synthetic peptide
  N-terminus acetylated
  C-terminus amidated
DDPKLYDKDLGSALGDTVVAWMDAAWSL

SEQ ID NO: 2315 - protein, 28 aa, Artificial Sequence
  Description of Artificial Sequence: Synthetic peptide
  N-terminus acetylated
DDPKLYDKDLGSALGDTVVAWMDAAWSL

SEQ ID NO: 2316 - protein, 28 aa, Artificial Sequence
  Description of Artificial Sequence: Synthetic peptide
  N-terminus acetylated
  C-terminus amidated
DDPKLYDKDLGSALGDTVVAWMDAATSL

SEQ ID NO: 2317 - protein, 28 aa, Artificial Sequence
  Description of Artificial Sequence: Synthetic peptide
  N-terminus acetylated
DDPKLYDKDLGSALGDTVVAWMDAATSL

SEQ ID NO: 2318 - protein, 28 aa, Artificial Sequence
  Description of Artificial Sequence: Synthetic peptide
  N-terminus acetylated
  C-terminus amidated
DDPKLYDKDLGSALGDTVVAQVDAAWSL

SEQ ID NO: 2319 - protein, 28 aa, Artificial Sequence
  Description of Artificial Sequence: Synthetic peptide
  N-terminus acetylated
DDPKLYDKDLGSALGDTVVAQVDAAWSL

SEQ ID NO: 2320 - protein, 28 aa, Artificial Sequence
  Description of Artificial Sequence: Synthetic peptide
  N-terminus acetylated
  C-terminus amidated
DDPKLYDKDLGSALGDTVVAQVDAATSL

SEQ ID NO: 2321 - protein, 28 aa, Artificial Sequence
  Description of Artificial Sequence: Synthetic peptide
  N-terminus acetylated
DDPKLYDKDLGSALGDTVVAQVDAATSL

SEQ ID NO: 2322 - protein, 28 aa, Artificial Sequence
  Description of Artificial Sequence: Synthetic peptide
  N-terminus acetylated
  C-terminus amidated
DDPKLYDKDLGSALGDTVVAQLDAAWSL

SEQ ID NO: 2323 - protein, 28 aa, Artificial Sequence
  Description of Artificial Sequence: Synthetic peptide
  N-terminus acetylated
DDPKLYDKDLGSALGDTVVAQLDAAWSL

SEQ ID NO: 2324 - protein, 28 aa, Artificial Sequence
  Description of Artificial Sequence: Synthetic peptide
  N-terminus acetylated
  C-terminus amidated
DDPKLYDKDLGSALGDTVVAQLDAATSL

SEQ ID NO: 2325 - protein, 28 aa, Artificial Sequence
  Description of Artificial Sequence: Synthetic peptide
  N-terminus acetylated
DDPKLYDKDLGSALGDTVVAQLDAATSL

SEQ ID NO: 2326 - protein, 28 aa, Artificial Sequence
  Description of Artificial Sequence: Synthetic peptide
  N-terminus acetylated
  C-terminus amidated
DDPKLYDKDLGSALGDTVVAQMDAAWSL

SEQ ID NO: 2327 - protein, 28 aa, Artificial Sequence
  Description of Artificial Sequence: Synthetic peptide
  N-terminus acetylated
DDPKLYDKDLGSALGDTVVAQMDAAWSL

SEQ ID NO: 2328 - protein, 28 aa, Artificial Sequence
  Description of Artificial Sequence: Synthetic peptide
  N-terminus acetylated
  C-terminus amidated
DDPKLYDKDLGSALGDTVVAQMDAATSL

SEQ ID NO: 2329 - protein, 28 aa, Artificial Sequence
  Description of Artificial Sequence: Synthetic peptide
  N-terminus acetylated
DDPKLYDKDLGSALGDTVVAQMDAATSL

SEQ ID NO: 2330 - protein, 28 aa, Artificial Sequence
  Description of Artificial Sequence: Synthetic peptide
  N-terminus acetylated
  C-terminus amidated
DDPKLYDKDLGSALGDTVVGWVDAAWSL

SEQ ID NO: 2331 - protein, 28 aa, Artificial Sequence
  Description of Artificial Sequence: Synthetic peptide
  N-terminus acetylated
DDPKLYDKDLGSALGDTVVGWVDAAWSL

SEQ ID NO: 2332 - protein, 28 aa, Artificial Sequence
  Description of Artificial Sequence: Synthetic peptide
  N-terminus acetylated
  C-terminus amidated
DDPKLYDKDLGSALGDTVVGWVDAATSL

SEQ ID NO: 2333 - protein, 28 aa, Artificial Sequence
  Description of Artificial Sequence: Synthetic peptide
  N-terminus acetylated
DDPKLYDKDLGSALGDTVVGWVDAATSL

SEQ ID NO: 2334 - protein, 28 aa, Artificial Sequence
  Description of Artificial Sequence: Synthetic peptide
  N-terminus acetylated
  C-terminus amidated
DDPKLYDKDLGSALGDTVVGWLDAAWSL

SEQ ID NO: 2335 - protein, 28 aa, Artificial Sequence
  Description of Artificial Sequence: Synthetic peptide
  N-terminus acetylated
DDPKLYDKDLGSALGDTVVGWLDAAWSL

SEQ ID NO: 2336 - protein, 28 aa, Artificial Sequence
  Description of Artificial Sequence: Synthetic peptide
  N-terminus acetylated
  C-terminus amidated
DDPKLYDKDLGSALGDTVVGWLDAATSL

SEQ ID NO: 2337 - protein, 28 aa, Artificial Sequence
  Description of Artificial Sequence: Synthetic peptide
  N-terminus acetylated
DDPKLYDKDLGSALGDTVVGWLDAATSL

SEQ ID NO: 2338 - protein, 28 aa, Artificial Sequence
  Description of Artificial Sequence: Synthetic peptide
  N-terminus acetylated
  C-terminus amidated
DDPKLYDKDLGSALGDTVVGWMDAAWSL

SEQ ID NO: 2339 - protein, 28 aa, Artificial Sequence
  Description of Artificial Sequence: Synthetic peptide
  N-terminus acetylated
DDPKLYDKDLGSALGDTVVGWMDAAWSL

SEQ ID NO: 2340 - protein, 28 aa, Artificial Sequence
  Description of Artificial Sequence: Synthetic peptide
  N-terminus acetylated
  C-terminus amidated
DDPKLYDKDLGSALGDTVVGWMDAATSL

SEQ ID NO: 2341 - protein, 28 aa, Artificial Sequence
  Description of Artificial Sequence: Synthetic peptide
  N-terminus acetylated
DDPKLYDKDLGSALGDTVVGWMDAATSL

SEQ ID NO: 2342 - protein, 28 aa, Artificial Sequence
  Description of Artificial Sequence: Synthetic peptide
  N-terminus acetylated
  C-terminus amidated
DDPKLYDKDLGSALGDTVVGQVDAAWSL

SEQ ID NO: 2343 - protein, 28 aa, Artificial Sequence
  Description of Artificial Sequence: Synthetic peptide
  N-terminus acetylated
DDPKLYDKDLGSALGDTVVGQVDAAWSL

SEQ ID NO: 2344 - protein, 28 aa, Artificial Sequence
  Description of Artificial Sequence: Synthetic peptide
  N-terminus acetylated
  C-terminus amidated
DDPKLYDKDLGSALGDTVVGQVDAATSL

SEQ ID NO: 2345 - protein, 28 aa, Artificial Sequence
  Description of Artificial Sequence: Synthetic peptide
  N-terminus acetylated
DDPKLYDKDLGSALGDTVVGQVDAATSL

SEQ ID NO: 2346 - protein, 28 aa, Artificial Sequence
  Description of Artificial Sequence: Synthetic peptide
  N-terminus acetylated
  C-terminus amidated
DDPKLYDKDLGSALGDTVVGQLDAAWSL

SEQ ID NO: 2347 - protein, 28 aa, Artificial Sequence
  Description of Artificial Sequence: Synthetic peptide
  N-terminus acetylated
DDPKLYDKDLGSALGDTVVGQLDAAWSL

SEQ ID NO: 2348 - protein, 28 aa, Artificial Sequence
  Description of Artificial Sequence: Synthetic peptide
  N-terminus acetylated
  C-terminus amidated
DDPKLYDKDLGSALGDTVVGQLDAATSL

SEQ ID NO: 2349 - protein, 28 aa, Artificial Sequence
  Description of Artificial Sequence: Synthetic peptide
  N-terminus acetylated
DDPKLYDKDLGSALGDTVVGQLDAATSL

SEQ ID NO: 2350 - protein, 28 aa, Artificial Sequence
  Description of Artificial Sequence: Synthetic peptide
  N-terminus acetylated
  C-terminus amidated
DDPKLYDKDLGSALGDTVVGQMDAAWSL

SEQ ID NO: 2351 - protein, 28 aa, Artificial Sequence
  Description of Artificial Sequence: Synthetic peptide
  N-terminus acetylated
DDPKLYDKDLGSALGDTVVGQMDAAWSL

SEQ ID NO: 2352 - protein, 28 aa, Artificial Sequence
  Description of Artificial Sequence: Synthetic peptide
  N-terminus acetylated
  C-terminus amidated
DDPKLYDKDLGSALGDTVVGQMDAATSL

SEQ ID NO: 2353 - protein, 28 aa, Artificial Sequence
  Description of Artificial Sequence: Synthetic peptide
  N-terminus acetylated
DDPKLYDKDLGSALGDTVVGQMDAATSL

SEQ ID NO: 2354 - protein, 28 aa, Artificial Sequence
  Description of Artificial Sequence: Synthetic peptide
  N-terminus acetylated
  C-terminus amidated
DDPKLYDKDLGSAMWDWVVAWVDAAWSL

SEQ ID NO: 2355 - protein, 28 aa, Artificial Sequence
  Description of Artificial Sequence: Synthetic peptide
  N-terminus acetylated
DDPKLYDKDLGSAMWDWVVAWVDAAWSL

SEQ ID NO: 2356 - protein, 28 aa, Artificial Sequence
  Description of Artificial Sequence: Synthetic peptide
  N-terminus acetylated
  C-terminus amidated
DDPKLYDKDLGSAMWDWVVAWVDAATSL

SEQ ID NO: 2357 - protein, 28 aa, Artificial Sequence
  Description of Artificial Sequence: Synthetic peptide
  N-terminus acetylated
DDPKLYDKDLGSAMWDWVVAWVDAATSL

SEQ ID NO: 2358 - protein, 28 aa, Artificial Sequence
  Description of Artificial Sequence: Synthetic peptide
  N-terminus acetylated
  C-terminus amidated
DDPKLYDKDLGSAMWDWVVAWLDAAWSL

SEQ ID NO: 2359 - protein, 28 aa, Artificial Sequence
  Description of Artificial Sequence: Synthetic peptide
  N-terminus acetylated
DDPKLYDKDLGSAMWDWVVAWLDAAWSL

SEQ ID NO: 2360 - protein, 28 aa, Artificial Sequence
  Description of Artificial Sequence: Synthetic peptide
  N-terminus acetylated
  C-terminus amidated
DDPKLYDKDLGSAMWDWVVAWLDAATSL

SEQ ID NO: 2361 - protein, 28 aa, Artificial Sequence
  Description of Artificial Sequence: Synthetic peptide
  N-terminus acetylated
DDPKLYDKDLGSAMWDWVVAWLDAATSL

SEQ ID NO: 2362 - protein, 28 aa, Artificial Sequence
  Description of Artificial Sequence: Synthetic peptide
  N-terminus acetylated
  C-terminus amidated
DDPKLYDKDLGSAMWDWVVAWMDAAWSL

SEQ ID NO: 2363 - protein, 28 aa, Artificial Sequence
  Description of Artificial Sequence: Synthetic peptide
  N-terminus acetylated
DDPKLYDKDLGSAMWDWVVAWMDAAWSL

SEQ ID NO: 2364 - protein, 28 aa, Artificial Sequence
  Description of Artificial Sequence: Synthetic peptide
  N-terminus acetylated
  C-terminus amidated
DDPKLYDKDLGSAMWDWVVAWMDAATSL

SEQ ID NO: 2365 - protein, 28 aa, Artificial Sequence
  Description of Artificial Sequence: Synthetic peptide
  N-terminus acetylated
DDPKLYDKDLGSAMWDWVVAWMDAATSL

SEQ ID NO: 2366 - protein, 28 aa, Artificial Sequence
  Description of Artificial Sequence: Synthetic peptide
  N-terminus acetylated
  C-terminus amidated
DDPKLYDKDLGSAMWDWVVAQVDAAWSL

SEQ ID NO: 2367 - protein, 28 aa, Artificial Sequence
  Description of Artificial Sequence: Synthetic peptide
  N-terminus acetylated
DDPKLYDKDLGSAMWDWVVAQVDAAWSL

SEQ ID NO: 2368 - protein, 28 aa, Artificial Sequence
  Description of Artificial Sequence: Synthetic peptide
  N-terminus acetylated
  C-terminus amidated
DDPKLYDKDLGSAMWDWVVAQVDAATSL

SEQ ID NO: 2369 - protein, 28 aa, Artificial Sequence
  Description of Artificial Sequence: Synthetic peptide
  N-terminus acetylated
DDPKLYDKDLGSAMWDWVVAQVDAATSL

SEQ ID NO: 2370 - protein, 28 aa, Artificial Sequence
  Description of Artificial Sequence: Synthetic peptide
  N-terminus acetylated
  C-terminus amidated
DDPKLYDKDLGSAMWDWVVAQLDAAWSL

SEQ ID NO: 2371 - protein, 28 aa, Artificial Sequence
  Description of Artificial Sequence: Synthetic peptide
  N-terminus acetylated
DDPKLYDKDLGSAMWDWVVAQLDAAWSL

SEQ ID NO: 2372 - protein, 28 aa, Artificial Sequence
  Description of Artificial Sequence: Synthetic peptide
  N-terminus acetylated
  C-terminus amidated
DDPKLYDKDLGSAMWDWVVAQLDAATSL

SEQ ID NO: 2373 - protein, 28 aa, Artificial Sequence
  Description of Artificial Sequence: Synthetic peptide
  N-terminus acetylated
DDPKLYDKDLGSAMWDWVVAQLDAATSL

SEQ ID NO: 2374 - protein, 28 aa, Artificial Sequence
  Description of Artificial Sequence: Synthetic peptide
  N-terminus acetylated
  C-terminus amidated
DDPKLYDKDLGSAMWDWVVAQMDAAWSL

SEQ ID NO: 2375 - protein, 28 aa, Artificial Sequence
  Description of Artificial Sequence: Synthetic peptide
  N-terminus acetylated
DDPKLYDKDLGSAMWDWVVAQMDAAWSL

SEQ ID NO: 2376 - protein, 28 aa, Artificial Sequence
  Description of Artificial Sequence: Synthetic peptide
  N-terminus acetylated
  C-terminus amidated
DDPKLYDKDLGSAMWDWVVAQMDAATSL

SEQ ID NO: 2377 - protein, 28 aa, Artificial Sequence
  Description of Artificial Sequence: Synthetic peptide
  N-terminus acetylated
DDPKLYDKDLGSAMWDWVVAQMDAATSL

SEQ ID NO: 2378 - protein, 28 aa, Artificial Sequence
  Description of Artificial Sequence: Synthetic peptide
  N-terminus acetylated
  C-terminus amidated
DDPKLYDKDLGSAMWDWVVGWVDAAWSL

SEQ ID NO: 2379 - protein, 28 aa, Artificial Sequence
  Description of Artificial Sequence: Synthetic peptide
  N-terminus acetylated
DDPKLYDKDLGSAMWDWVVGWVDAAWSL

SEQ ID NO: 2380 - protein, 28 aa, Artificial Sequence
  Description of Artificial Sequence: Synthetic peptide
  N-terminus acetylated
  C-terminus amidated
DDPKLYDKDLGSAMWDWVVGWVDAATSL

SEQ ID NO: 2381 - protein, 28 aa, Artificial Sequence
  Description of Artificial Sequence: Synthetic peptide
  N-terminus acetylated
DDPKLYDKDLGSAMWDWVVGWVDAATSL

SEQ ID NO: 2382 - protein, 28 aa, Artificial Sequence
  Description of Artificial Sequence: Synthetic peptide
  N-terminus acetylated
  C-terminus amidated
DDPKLYDKDLGSAMWDWVVGWLDAAWSL

SEQ ID NO: 2383 - protein, 28 aa, Artificial Sequence
  Description of Artificial Sequence: Synthetic peptide
  N-terminus acetylated
DDPKLYDKDLGSAMWDWVVGWLDAAWSL

SEQ ID NO: 2384 - protein, 28 aa, Artificial Sequence
  Description of Artificial Sequence: Synthetic peptide
  N-terminus acetylated
  C-terminus amidated
DDPKLYDKDLGSAMWDWVVGWLDAATSL

SEQ ID NO: 2385 - protein, 28 aa, Artificial Sequence
  Description of Artificial Sequence: Synthetic peptide
  N-terminus acetylated
DDPKLYDKDLGSAMWDWVVGWLDAATSL

SEQ ID NO: 2386 - protein, 28 aa, Artificial Sequence
  Description of Artificial Sequence: Synthetic peptide
  N-terminus acetylated
  C-terminus amidated
DDPKLYDKDLGSAMWDWVVGWMDAAWSL

SEQ ID NO: 2387 - protein, 28 aa, Artificial Sequence
  Description of Artificial Sequence: Synthetic peptide
  N-terminus acetylated
DDPKLYDKDLGSAMWDWVVGWMDAAWSL

SEQ ID NO: 2388 - protein, 28 aa, Artificial Sequence
  Description of Artificial Sequence: Synthetic peptide
  N-terminus acetylated
  C-terminus amidated
DDPKLYDKDLGSAMWDWVVGWMDAATSL

SEQ ID NO: 2389 - protein, 28 aa, Artificial Sequence
  Description of Artificial Sequence: Synthetic peptide
  N-terminus acetylated
DDPKLYDKDLGSAMWDWVVGWMDAATSL

SEQ ID NO: 2390 - protein, 28 aa, Artificial Sequence
  Description of Artificial Sequence: Synthetic peptide
  N-terminus acetylated
  C-terminus amidated
DDPKLYDKDLGSAMWDWVVGQVDAAWSL

SEQ ID NO: 2391 - protein, 28 aa, Artificial Sequence
  Description of Artificial Sequence: Synthetic peptide
  N-terminus acetylated
DDPKLYDKDLGSAMWDWVVGQVDAAWSL

SEQ ID NO: 2392 - protein, 28 aa, Artificial Sequence
  Description of Artificial Sequence: Synthetic peptide
  N-terminus acetylated
  C-terminus amidated
DDPKLYDKDLGSAMWDWVVGQVDAATSL

SEQ ID NO: 2393 - protein, 28 aa, Artificial Sequence
  Description of Artificial Sequence: Synthetic peptide
  N-terminus acetylated
DDPKLYDKDLGSAMWDWVVGQVDAATSL

SEQ ID NO: 2394 - protein, 28 aa, Artificial Sequence
  Description of Artificial Sequence: Synthetic peptide
  N-terminus acetylated
  C-terminus amidated
DDPKLYDKDLGSAMWDWVVGQLDAAWSL

SEQ ID NO: 2395 - protein, 28 aa, Artificial Sequence
  Description of Artificial Sequence: Synthetic peptide
  N-terminus acetylated
DDPKLYDKDLGSAMWDWVVGQLDAAWSL

SEQ ID NO: 2396 - protein, 28 aa, Artificial Sequence
  Description of Artificial Sequence: Synthetic peptide
  N-terminus acetylated
  C-terminus amidated
DDPKLYDKDLGSAMWDWVVGQLDAATSL

SEQ ID NO: 2397 - protein, 28 aa, Artificial Sequence
  Description of Artificial Sequence: Synthetic peptide
  N-terminus acetylated
DDPKLYDKDLGSAMWDWVVGQLDAATSL

SEQ ID NO: 2398 - protein, 28 aa, Artificial Sequence
  Description of Artificial Sequence: Synthetic peptide
  N-terminus acetylated
  C-terminus amidated
DDPKLYDKDLGSAMWDWVVGQMDAAWSL

SEQ ID NO: 2399 - protein, 28 aa, Artificial Sequence
  Description of Artificial Sequence: Synthetic peptide
  N-terminus acetylated
DDPKLYDKDLGSAMWDWVVGQMDAAWSL

SEQ ID NO: 2400 - protein, 28 aa, Artificial Sequence
  Description of Artificial Sequence: Synthetic peptide
  N-terminus acetylated
  C-terminus amidated
DDPKLYDKDLGSAMWDWVVGQMDAATSL

SEQ ID NO: 2401 - protein, 28 aa, Artificial Sequence
  Description of Artificial Sequence: Synthetic peptide
  N-terminus acetylated
DDPKLYDKDLGSAMWDWVVGQMDAATSL

SEQ ID NO: 2402 - protein, 28 aa, Artificial Sequence
  Description of Artificial Sequence: Synthetic peptide
  N-terminus acetylated
  C-terminus amidated
DDPKLYDKDLGSAMWDTVVAWVDAAWSL

SEQ ID NO: 2403 - protein, 28 aa, Artificial Sequence
  Description of Artificial Sequence: Synthetic peptide
  N-terminus acetylated
DDPKLYDKDLGSAMWDTVVAWVDAAWSL

SEQ ID NO: 2404 - protein, 28 aa, Artificial Sequence
  Description of Artificial Sequence: Synthetic peptide
  N-terminus acetylated
  C-terminus amidated
DDPKLYDKDLGSAMWDTVVAWVDAATSL

SEQ ID NO: 2405 - protein, 28 aa, Artificial Sequence
  Description of Artificial Sequence: Synthetic peptide
  N-terminus acetylated
DDPKLYDKDLGSAMWDTVVAWVDAATSL

SEQ ID NO: 2406 - protein, 28 aa, Artificial Sequence
  Description of Artificial Sequence: Synthetic peptide
  N-terminus acetylated
  C-terminus amidated
DDPKLYDKDLGSAMWDTVVAWLDAAWSL

SEQ ID NO: 2407 - protein, 28 aa, Artificial Sequence
  Description of Artificial Sequence: Synthetic peptide
  N-terminus acetylated
DDPKLYDKDLGSAMWDTVVAWLDAAWSL

SEQ ID NO: 2408 - protein, 28 aa, Artificial Sequence
  Description of Artificial Sequence: Synthetic peptide
  N-terminus acetylated
  C-terminus amidated
DDPKLYDKDLGSAMWDTVVAWLDAATSL

SEQ ID NO: 2409 - protein, 28 aa, Artificial Sequence
  Description of Artificial Sequence: Synthetic peptide
  N-terminus acetylated
DDPKLYDKDLGSAMWDTVVAWLDAATSL

SEQ ID NO: 2410 - protein, 28 aa, Artificial Sequence
  Description of Artificial Sequence: Synthetic peptide
  N-terminus acetylated
  C-terminus amidated
DDPKLYDKDLGSAMWDTVVAWMDAAWSL

SEQ ID NO: 2411 - protein, 28 aa, Artificial Sequence
  Description of Artificial Sequence: Synthetic peptide
  N-terminus acetylated
DDPKLYDKDLGSAMWDTVVAWMDAAWSL

SEQ ID NO: 2412 - protein, 28 aa, Artificial Sequence
  Description of Artificial Sequence: Synthetic peptide
  N-terminus acetylated
  C-terminus amidated
DDPKLYDKDLGSAMWDTVVAWMDAATSL

SEQ ID NO: 2413 - protein, 28 aa, Artificial Sequence
  Description of Artificial Sequence: Synthetic peptide
  N-terminus acetylated
DDPKLYDKDLGSAMWDTVVAWMDAATSL

SEQ ID NO: 2414 - protein, 28 aa, Artificial Sequence
  Description of Artificial Sequence: Synthetic peptide
  N-terminus acetylated
  C-terminus amidated
DDPKLYDKDLGSAMWDTVVAQVDAAWSL

SEQ ID NO: 2415 - protein, 28 aa, Artificial Sequence
  Description of Artificial Sequence: Synthetic peptide
  N-terminus acetylated
DDPKLYDKDLGSAMWDTVVAQVDAAWSL

SEQ ID NO: 2416 - protein, 28 aa, Artificial Sequence
  Description of Artificial Sequence: Synthetic peptide
  N-terminus acetylated
  C-terminus amidated
DDPKLYDKDLGSAMWDTVVAQVDAATSL

SEQ ID NO: 2417 - protein, 28 aa, Artificial Sequence
  Description of Artificial Sequence: Synthetic peptide
  N-terminus acetylated
DDPKLYDKDLGSAMWDTVVAQVDAATSL

SEQ ID NO: 2418 - protein, 28 aa, Artificial Sequence
  Description of Artificial Sequence: Synthetic peptide
  N-terminus acetylated
  C-terminus amidated
DDPKLYDKDLGSAMWDTVVAQLDAAWSL

SEQ ID NO: 2419 - protein, 28 aa, Artificial Sequence
  Description of Artificial Sequence: Synthetic peptide
  N-terminus acetylated
DDPKLYDKDLGSAMWDTVVAQLDAAWSL

SEQ ID NO: 2420 - protein, 28 aa, Artificial Sequence
  Description of Artificial Sequence: Synthetic peptide
  N-terminus acetylated
  C-terminus amidated
DDPKLYDKDLGSAMWDTVVAQLDAATSL

SEQ ID NO: 2421 - protein, 28 aa, Artificial Sequence
  Description of Artificial Sequence: Synthetic peptide
  N-terminus acetylated
DDPKLYDKDLGSAMWDTVVAQLDAATSL

SEQ ID NO: 2422 - protein, 28 aa, Artificial Sequence
  Description of Artificial Sequence: Synthetic peptide
  N-terminus acetylated
  C-terminus amidated
DDPKLYDKDLGSAMWDTVVAQMDAAWSL

SEQ ID NO: 2423 - protein, 28 aa, Artificial Sequence
  Description of Artificial Sequence: Synthetic peptide
  N-terminus acetylated
DDPKLYDKDLGSAMWDTVVAQMDAAWSL

SEQ ID NO: 2424 - protein, 28 aa, Artificial Sequence
  Description of Artificial Sequence: Synthetic peptide
  N-terminus acetylated
  C-terminus amidated
DDPKLYDKDLGSAMWDTVVAQMDAATSL

SEQ ID NO: 2425 - protein, 28 aa, Artificial Sequence
  Description of Artificial Sequence: Synthetic peptide
  N-terminus acetylated
DDPKLYDKDLGSAMWDTVVAQMDAATSL

SEQ ID NO: 2426 - protein, 28 aa, Artificial Sequence
  Description of Artificial Sequence: Synthetic peptide
  N-terminus acetylated
  C-terminus amidated
DDPKLYDKDLGSAMWDTVVGWVDAAWSL

SEQ ID NO: 2427 - protein, 28 aa, Artificial Sequence
  Description of Artificial Sequence: Synthetic peptide
  N-terminus acetylated
DDPKLYDKDLGSAMWDTVVGWVDAAWSL

SEQ ID NO: 2428 - protein, 28 aa, Artificial Sequence
  Description of Artificial Sequence: Synthetic peptide
  N-terminus acetylated
  C-terminus amidated
DDPKLYDKDLGSAMWDTVVGWVDAATSL

SEQ ID NO: 2429 - protein, 28 aa, Artificial Sequence
  Description of Artificial Sequence: Synthetic peptide
  N-terminus acetylated
DDPKLYDKDLGSAMWDTVVGWVDAATSL

SEQ ID NO: 2430 - protein, 28 aa, Artificial Sequence
  Description of Artificial Sequence: Synthetic peptide
  N-terminus acetylated
  C-terminus amidated
DDPKLYDKDLGSAMWDTVVGWLDAAWSL

SEQ ID NO: 2431 - protein, 28 aa, Artificial Sequence
  Description of Artificial Sequence: Synthetic peptide
  N-terminus acetylated
DDPKLYDKDLGSAMWDTVVGWLDAAWSL

SEQ ID NO: 2432 - protein, 28 aa, Artificial Sequence
  Description of Artificial Sequence: Synthetic peptide
  N-terminus acetylated
  C-terminus amidated
DDPKLYDKDLGSAMWDTVVGWLDAATSL

SEQ ID NO: 2433 - protein, 28 aa, Artificial Sequence
  Description of Artificial Sequence: Synthetic peptide
  N-terminus acetylated
DDPKLYDKDLGSAMWDTVVGWLDAATSL

SEQ ID NO: 2434 - protein, 28 aa, Artificial Sequence
  Description of Artificial Sequence: Synthetic peptide
  N-terminus acetylated
  C-terminus amidated
DDPKLYDKDLGSAMWDTVVGWMDAAWSL

SEQ ID NO: 2435 - protein, 28 aa, Artificial Sequence
  Description of Artificial Sequence: Synthetic peptide
  N-terminus acetylated
DDPKLYDKDLGSAMWDTVVGWMDAAWSL

SEQ ID NO: 2436 - protein, 28 aa, Artificial Sequence
  Description of Artificial Sequence: Synthetic peptide
  N-terminus acetylated
  C-terminus amidated
DDPKLYDKDLGSAMWDTVVGWMDAATSL

SEQ ID NO: 2437 - protein, 28 aa, Artificial Sequence
  Description of Artificial Sequence: Synthetic peptide
  N-terminus acetylated
DDPKLYDKDLGSAMWDTVVGWMDAATSL

SEQ ID NO: 2438 - protein, 28 aa, Artificial Sequence
  Description of Artificial Sequence: Synthetic peptide
  N-terminus acetylated
  C-terminus amidated
DDPKLYDKDLGSAMWDTVVGQVDAAWSL

SEQ ID NO: 2439 - protein, 28 aa, Artificial Sequence
  Description of Artificial Sequence: Synthetic peptide
  N-terminus acetylated
DDPKLYDKDLGSAMWDTVVGQVDAAWSL

SEQ ID NO: 2440 - protein, 28 aa, Artificial Sequence
  Description of Artificial Sequence: Synthetic peptide
  N-terminus acetylated
  C-terminus amidated
DDPKLYDKDLGSAMWDTVVGQVDAATSL

SEQ ID NO: 2441 - protein, 28 aa, Artificial Sequence
  Description of Artificial Sequence: Synthetic peptide
  N-terminus acetylated
DDPKLYDKDLGSAMWDTVVGQVDAATSL

SEQ ID NO: 2442 - protein, 28 aa, Artificial Sequence
  Description of Artificial Sequence: Synthetic peptide
  N-terminus acetylated
  C-terminus amidated
DDPKLYDKDLGSAMWDTVVGQLDAAWSL

SEQ ID NO: 2443 - protein, 28 aa, Artificial Sequence
  Description of Artificial Sequence: Synthetic peptide
  N-terminus acetylated
DDPKLYDKDLGSAMWDTVVGQLDAAWSL

SEQ ID NO: 2444 - protein, 28 aa, Artificial Sequence
  Description of Artificial Sequence: Synthetic peptide
  N-terminus acetylated
  C-terminus amidated
DDPKLYDKDLGSAMWDTVVGQLDAATSL

SEQ ID NO: 2445 - protein, 28 aa, Artificial Sequence
  Description of Artificial Sequence: Synthetic peptide
  N-terminus acetylated
DDPKLYDKDLGSAMWDTVVGQLDAATSL

SEQ ID NO: 2446 - protein, 28 aa, Artificial Sequence
  Description of Artificial Sequence: Synthetic peptide
  N-terminus acetylated
  C-terminus amidated
DDPKLYDKDLGSAMWDTVVGQMDAAWSL

SEQ ID NO: 2447 - protein, 28 aa, Artificial Sequence
  Description of Artificial Sequence: Synthetic peptide
  N-terminus acetylated
DDPKLYDKDLGSAMWDTVVGQMDAAWSL

SEQ ID NO: 2448 - protein, 28 aa, Artificial Sequence
  Description of Artificial Sequence: Synthetic peptide
  N-terminus acetylated
  C-terminus amidated
DDPKLYDKDLGSAMWDTVVGQMDAATSL

SEQ ID NO: 2449 - protein, 28 aa, Artificial Sequence
  Description of Artificial Sequence: Synthetic peptide
  N-terminus acetylated
DDPKLYDKDLGSAMWDTVVGQMDAATSL

SEQ ID NO: 2450 - protein, 28 aa, Artificial Sequence
  Description of Artificial Sequence: Synthetic peptide
  N-terminus acetylated
  C-terminus amidated
DDPKLYDKDLGSAMTDWVVAWVDAAWSL

SEQ ID NO: 2451 - protein, 28 aa, Artificial Sequence
  Description of Artificial Sequence: Synthetic peptide
  N-terminus acetylated
DDPKLYDKDLGSAMTDWVVAWVDAAWSL

SEQ ID NO: 2452 - protein, 28 aa, Artificial Sequence
  Description of Artificial Sequence: Synthetic peptide
  N-terminus acetylated
  C-terminus amidated
DDPKLYDKDLGSAMTDWVVAWVDAATSL

SEQ ID NO: 2453 - protein, 28 aa, Artificial Sequence
  Description of Artificial Sequence: Synthetic peptide
  N-terminus acetylated
DDPKLYDKDLGSAMTDWVVAWVDAATSL

SEQ ID NO: 2454 - protein, 28 aa, Artificial Sequence
  Description of Artificial Sequence: Synthetic peptide
  N-terminus acetylated
  C-terminus amidated
DDPKLYDKDLGSAMTDWVVAWLDAAWSL

SEQ ID NO: 2455 - protein, 28 aa, Artificial Sequence
  Description of Artificial Sequence: Synthetic peptide
  N-terminus acetylated
DDPKLYDKDLGSAMTDWVVAWLDAAWSL

SEQ ID NO: 2456 - protein, 28 aa, Artificial Sequence
  Description of Artificial Sequence: Synthetic peptide
  N-terminus acetylated
  C-terminus amidated
DDPKLYDKDLGSAMTDWVVAWLDAATSL

SEQ ID NO: 2457 - protein, 28 aa, Artificial Sequence
  Description of Artificial Sequence: Synthetic peptide
  N-terminus acetylated
DDPKLYDKDLGSAMTDWVVAWLDAATSL

SEQ ID NO: 2458 - protein, 28 aa, Artificial Sequence
  Description of Artificial Sequence: Synthetic peptide
  N-terminus acetylated
  C-terminus amidated
DDPKLYDKDLGSAMTDWVVAWMDAAWSL

SEQ ID NO: 2459 - protein, 28 aa, Artificial Sequence
  Description of Artificial Sequence: Synthetic peptide
  N-terminus acetylated
DDPKLYDKDLGSAMTDWVVAWMDAAWSL

SEQ ID NO: 2460 - protein, 28 aa, Artificial Sequence
  Description of Artificial Sequence: Synthetic peptide
  N-terminus acetylated
  C-terminus amidated
DDPKLYDKDLGSAMTDWVVAWMDAATSL

SEQ ID NO: 2461 - protein, 28 aa, Artificial Sequence
  Description of Artificial Sequence: Synthetic peptide
  N-terminus acetylated
DDPKLYDKDLGSAMTDWVVAWMDAATSL

SEQ ID NO: 2462 - protein, 28 aa, Artificial Sequence
  Description of Artificial Sequence: Synthetic peptide
  N-terminus acetylated
  C-terminus amidated
DDPKLYDKDLGSAMTDWVVAQVDAAWSL

SEQ ID NO: 2463 - protein, 28 aa, Artificial Sequence
  Description of Artificial Sequence: Synthetic peptide
  N-terminus acetylated
DDPKLYDKDLGSAMTDWVVAQVDAAWSL

SEQ ID NO: 2464 - protein, 28 aa, Artificial Sequence
  Description of Artificial Sequence: Synthetic peptide
  N-terminus acetylated
  C-terminus amidated
DDPKLYDKDLGSAMTDWVVAQVDAATSL

SEQ ID NO: 2465 - protein, 28 aa, Artificial Sequence
  Description of Artificial Sequence: Synthetic peptide
  N-terminus acetylated
DDPKLYDKDLGSAMTDWVVAQVDAATSL

SEQ ID NO: 2466 - protein, 28 aa, Artificial Sequence
  Description of Artificial Sequence: Synthetic peptide
  N-terminus acetylated
  C-terminus amidated
DDPKLYDKDLGSAMTDWVVAQLDAAWSL

SEQ ID NO: 2467 - protein, 28 aa, Artificial Sequence
  Description of Artificial Sequence: Synthetic peptide
  N-terminus acetylated
DDPKLYDKDLGSAMTDWVVAQLDAAWSL

SEQ ID NO: 2468 - protein, 28 aa, Artificial Sequence
  Description of Artificial Sequence: Synthetic peptide
  N-terminus acetylated
  C-terminus amidated
DDPKLYDKDLGSAMTDWVVAQLDAATSL

SEQ ID NO: 2469 - protein, 28 aa, Artificial Sequence
  Description of Artificial Sequence: Synthetic peptide
  N-terminus acetylated
DDPKLYDKDLGSAMTDWVVAQLDAATSL

SEQ ID NO: 2470 - protein, 28 aa, Artificial Sequence
  Description of Artificial Sequence: Synthetic peptide
  N-terminus acetylated
  C-terminus amidated
DDPKLYDKDLGSAMTDWVVAQMDAAWSL

SEQ ID NO: 2471 - protein, 28 aa, Artificial Sequence
  Description of Artificial Sequence: Synthetic peptide
  N-terminus acetylated
DDPKLYDKDLGSAMTDWVVAQMDAAWSL

SEQ ID NO: 2472 - protein, 28 aa, Artificial Sequence
  Description of Artificial Sequence: Synthetic peptide
  N-terminus acetylated
  C-terminus amidated
DDPKLYDKDLGSAMTDWVVAQMDAATSL

SEQ ID NO: 2473 - protein, 28 aa, Artificial Sequence
  Description of Artificial Sequence: Synthetic peptide
  N-terminus acetylated
DDPKLYDKDLGSAMTDWVVAQMDAATSL

SEQ ID NO: 2474 - protein, 28 aa, Artificial Sequence
  Description of Artificial Sequence: Synthetic peptide
  N-terminus acetylated
  C-terminus amidated
DDPKLYDKDLGSAMTDWVVGWVDAAWSL

SEQ ID NO: 2475 - protein, 28 aa, Artificial Sequence
  Description of Artificial Sequence: Synthetic peptide
  N-terminus acetylated
DDPKLYDKDLGSAMTDWVVGWVDAAWSL

SEQ ID NO: 2476 - protein, 28 aa, Artificial Sequence
  Description of Artificial Sequence: Synthetic peptide
  N-terminus acetylated
  C-terminus amidated
DDPKLYDKDLGSAMTDWVVGWVDAATSL

SEQ ID NO: 2477 - protein, 28 aa, Artificial Sequence
  Description of Artificial Sequence: Synthetic peptide
  N-terminus acetylated
DDPKLYDKDLGSAMTDWVVGWVDAATSL

SEQ ID NO: 2478 - protein, 28 aa, Artificial Sequence
  Description of Artificial Sequence: Synthetic peptide
  N-terminus acetylated
  C-terminus amidated
DDPKLYDKDLGSAMTDWVVGWLDAAWSL

SEQ ID NO: 2479 - protein, 28 aa, Artificial Sequence
  Description of Artificial Sequence: Synthetic peptide
  N-terminus acetylated
DDPKLYDKDLGSAMTDWVVGWLDAAWSL

SEQ ID NO: 2480 - protein, 28 aa, Artificial Sequence
  Description of Artificial Sequence: Synthetic peptide
  N-terminus acetylated
  C-terminus amidated
DDPKLYDKDLGSAMTDWVVGWLDAATSL

SEQ ID NO: 2481 - protein, 28 aa, Artificial Sequence
  Description of Artificial Sequence: Synthetic peptide
  N-terminus acetylated
DDPKLYDKDLGSAMTDWVVGWLDAATSL

SEQ ID NO: 2482 - protein, 28 aa, Artificial Sequence
  Description of Artificial Sequence: Synthetic peptide
  N-terminus acetylated
  C-terminus amidated
DDPKLYDKDLGSAMTDWVVGWMDAAWSL

SEQ ID NO: 2483 - protein, 28 aa, Artificial Sequence
  Description of Artificial Sequence: Synthetic peptide
  N-terminus acetylated
DDPKLYDKDLGSAMTDWVVGWMDAAWSL

SEQ ID NO: 2484 - protein, 28 aa, Artificial Sequence
  Description of Artificial Sequence: Synthetic peptide
  N-terminus acetylated
  C-terminus amidated
DDPKLYDKDLGSAMTDWVVGWMDAATSL

SEQ ID NO: 2485 - protein, 28 aa, Artificial Sequence
  Description of Artificial Sequence: Synthetic peptide
  N-terminus acetylated
DDPKLYDKDLGSAMTDWVVGWMDAATSL

SEQ ID NO: 2486 - protein, 28 aa, Artificial Sequence
  Description of Artificial Sequence: Synthetic peptide
  N-terminus acetylated
  C-terminus amidated
DDPKLYDKDLGSAMTDWVVGQVDAAWSL

SEQ ID NO: 2487 - protein, 28 aa, Artificial Sequence
  Description of Artificial Sequence: Synthetic peptide
  N-terminus acetylated
DDPKLYDKDLGSAMTDWVVGQVDAAWSL

SEQ ID NO: 2488 - protein, 28 aa, Artificial Sequence
  Description of Artificial Sequence: Synthetic peptide
  N-terminus acetylated
  C-terminus amidated
DDPKLYDKDLGSAMTDWVVGQVDAATSL

SEQ ID NO: 2489 - protein, 28 aa, Artificial Sequence
  Description of Artificial Sequence: Synthetic peptide
  N-terminus acetylated
DDPKLYDKDLGSAMTDWVVGQVDAATSL

SEQ ID NO: 2490 - protein, 28 aa, Artificial Sequence
  Description of Artificial Sequence: Synthetic peptide
  N-terminus acetylated
  C-terminus amidated
DDPKLYDKDLGSAMTDWVVGQLDAAWSL

SEQ ID NO: 2491 - protein, 28 aa, Artificial Sequence
  Description of Artificial Sequence: Synthetic peptide
  N-terminus acetylated
DDPKLYDKDLGSAMTDWVVGQLDAAWSL

SEQ ID NO: 2492 - protein, 28 aa, Artificial Sequence
  Description of Artificial Sequence: Synthetic peptide
  N-terminus acetylated
  C-terminus amidated
DDPKLYDKDLGSAMTDWVVGQLDAATSL

SEQ ID NO: 2493 - protein, 28 aa, Artificial Sequence
  Description of Artificial Sequence: Synthetic peptide
  N-terminus acetylated
DDPKLYDKDLGSAMTDWVVGQLDAATSL

SEQ ID NO: 2494 - protein, 28 aa, Artificial Sequence
  Description of Artificial Sequence: Synthetic peptide
  N-terminus acetylated
  C-terminus amidated
DDPKLYDKDLGSAMTDWVVGQMDAAWSL

SEQ ID NO: 2495 - protein, 28 aa, Artificial Sequence
  Description of Artificial Sequence: Synthetic peptide
  N-terminus acetylated
DDPKLYDKDLGSAMTDWVVGQMDAAWSL

SEQ ID NO: 2496 - protein, 28 aa, Artificial Sequence
  Description of Artificial Sequence: Synthetic peptide
  N-terminus acetylated
  C-terminus amidated
DDPKLYDKDLGSAMTDWVVGQMDAATSL

SEQ ID NO: 2497 - protein, 28 aa, Artificial Sequence
  Description of Artificial Sequence: Synthetic peptide
  N-terminus acetylated
DDPKLYDKDLGSAMTDWVVGQMDAATSL

SEQ ID NO: 2498 - protein, 28 aa, Artificial Sequence
  Description of Artificial Sequence: Synthetic peptide
  N-terminus acetylated
  C-terminus amidated
DDPKLYDKDLGSAMTDTVVAWVDAAWSL

SEQ ID NO: 2499 - protein, 28 aa, Artificial Sequence
  Description of Artificial Sequence: Synthetic peptide
  N-terminus acetylated
DDPKLYDKDLGSAMTDTVVAWVDAAWSL

SEQ ID NO: 2500 - protein, 28 aa, Artificial Sequence
  Description of Artificial Sequence: Synthetic peptide
  N-terminus acetylated
  C-terminus amidated
DDPKLYDKDLGSAMTDTVVAWVDAATSL

SEQ ID NO: 2501 - protein, 28 aa, Artificial Sequence
  Description of Artificial Sequence: Synthetic peptide
  N-terminus acetylated
DDPKLYDKDLGSAMTDTVVAWVDAATSL

SEQ ID NO: 2502 - protein, 28 aa, Artificial Sequence
  Description of Artificial Sequence: Synthetic peptide
  N-terminus acetylated
  C-terminus amidated
DDPKLYDKDLGSAMTDTVVAWLDAAWSL

SEQ ID NO: 2503 - protein, 28 aa, Artificial Sequence
  Description of Artificial Sequence: Synthetic peptide
  N-terminus acetylated
DDPKLYDKDLGSAMTDTVVAWLDAAWSL

SEQ ID NO: 2504 - protein, 28 aa, Artificial Sequence
  Description of Artificial Sequence: Synthetic peptide
  N-terminus acetylated
  C-terminus amidated
DDPKLYDKDLGSAMTDTVVAWLDAATSL

SEQ ID NO: 2505 - protein, 28 aa, Artificial Sequence
  Description of Artificial Sequence: Synthetic peptide
  N-terminus acetylated
DDPKLYDKDLGSAMTDTVVAWLDAATSL

SEQ ID NO: 2506 - protein, 28 aa, Artificial Sequence
  Description of Artificial Sequence: Synthetic peptide
  N-terminus acetylated
  C-terminus amidated
DDPKLYDKDLGSAMTDTVVAWMDAAWSL

SEQ ID NO: 2507 - protein, 28 aa, Artificial Sequence
  Description of Artificial Sequence: Synthetic peptide
  N-terminus acetylated
DDPKLYDKDLGSAMTDTVVAWMDAAWSL

SEQ ID NO: 2508 - protein, 28 aa, Artificial Sequence
  Description of Artificial Sequence: Synthetic peptide
  N-terminus acetylated
  C-terminus amidated
DDPKLYDKDLGSAMTDTVVAWMDAATSL

SEQ ID NO: 2509 - protein, 28 aa, Artificial Sequence
  Description of Artificial Sequence: Synthetic peptide
  N-terminus acetylated
DDPKLYDKDLGSAMTDTVVAWMDAATSL

SEQ ID NO: 2510 - protein, 28 aa, Artificial Sequence
  Description of Artificial Sequence: Synthetic peptide
  N-terminus acetylated
  C-terminus amidated
DDPKLYDKDLGSAMTDTVVAQVDAAWSL

SEQ ID NO: 2511 - protein, 28 aa, Artificial Sequence
  Description of Artificial Sequence: Synthetic peptide
  N-terminus acetylated
DDPKLYDKDLGSAMTDTVVAQVDAAWSL

SEQ ID NO: 2512 - protein, 28 aa, Artificial Sequence
  Description of Artificial Sequence: Synthetic peptide
  N-terminus acetylated
  C-terminus amidated
DDPKLYDKDLGSAMTDTVVAQVDAATSL

SEQ ID NO: 2513 - protein, 28 aa, Artificial Sequence
  Description of Artificial Sequence: Synthetic peptide
  N-terminus acetylated
DDPKLYDKDLGSAMTDTVVAQVDAATSL

SEQ ID NO: 2514 - protein, 28 aa, Artificial Sequence
  Description of Artificial Sequence: Synthetic peptide
  N-terminus acetylated
  C-terminus amidated
DDPKLYDKDLGSAMTDTVVAQLDAAWSL

SEQ ID NO: 2515 - protein, 28 aa, Artificial Sequence
  Description of Artificial Sequence: Synthetic peptide
  N-terminus acetylated
DDPKLYDKDLGSAMTDTVVAQLDAAWSL

SEQ ID NO: 2516 - protein, 28 aa, Artificial Sequence
  Description of Artificial Sequence: Synthetic peptide
  N-terminus acetylated
  C-terminus amidated
DDPKLYDKDLGSAMTDTVVAQLDAATSL

SEQ ID NO: 2517 - protein, 28 aa, Artificial Sequence
  Description of Artificial Sequence: Synthetic peptide
  N-terminus acetylated
DDPKLYDKDLGSAMTDTVVAQLDAATSL

SEQ ID NO: 2518 - protein, 28 aa, Artificial Sequence
  Description of Artificial Sequence: Synthetic peptide
  N-terminus acetylated
  C-terminus amidated
DDPKLYDKDLGSAMTDTVVAQMDAAWSL

SEQ ID NO: 2519 - protein, 28 aa, Artificial Sequence
  Description of Artificial Sequence: Synthetic peptide
  N-terminus acetylated
DDPKLYDKDLGSAMTDTVVAQMDAAWSL

SEQ ID NO: 2520 - protein, 28 aa, Artificial Sequence
  Description of Artificial Sequence: Synthetic peptide
  N-terminus acetylated
  C-terminus amidated
DDPKLYDKDLGSAMTDTVVAQMDAATSL

SEQ ID NO: 2521 - protein, 28 aa, Artificial Sequence
  Description of Artificial Sequence: Synthetic peptide
  N-terminus acetylated
DDPKLYDKDLGSAMTDTVVAQMDAATSL

SEQ ID NO: 2522 - protein, 28 aa, Artificial Sequence
  Description of Artificial Sequence: Synthetic peptide
  N-terminus acetylated
  C-terminus amidated
DDPKLYDKDLGSAMTDTVVGWVDAAWSL

SEQ ID NO: 2523 - protein, 28 aa, Artificial Sequence
  Description of Artificial Sequence: Synthetic peptide
  N-terminus acetylated
DDPKLYDKDLGSAMTDTVVGWVDAAWSL

SEQ ID NO: 2524 - protein, 28 aa, Artificial Sequence
  Description of Artificial Sequence: Synthetic peptide
  N-terminus acetylated
  C-terminus amidated
DDPKLYDKDLGSAMTDTVVGWVDAATSL

SEQ ID NO: 2525 - protein, 28 aa, Artificial Sequence
  Description of Artificial Sequence: Synthetic peptide
  N-terminus acetylated
DDPKLYDKDLGSAMTDTVVGWVDAATSL

SEQ ID NO: 2526 - protein, 28 aa, Artificial Sequence
  Description of Artificial Sequence: Synthetic peptide
  N-terminus acetylated
  C-terminus amidated
DDPKLYDKDLGSAMTDTVVGWLDAAWSL

SEQ ID NO: 2527 - protein, 28 aa, Artificial Sequence
  Description of Artificial Sequence: Synthetic peptide
  N-terminus acetylated
DDPKLYDKDLGSAMTDTVVGWLDAAWSL

SEQ ID NO: 2528 - protein, 28 aa, Artificial Sequence
  Description of Artificial Sequence: Synthetic peptide
  N-terminus acetylated
  C-terminus amidated
DDPKLYDKDLGSAMTDTVVGWLDAATSL

SEQ ID NO: 2529 - protein, 28 aa, Artificial Sequence
  Description of Artificial Sequence: Synthetic peptide
  N-terminus acetylated
DDPKLYDKDLGSAMTDTVVGWLDAATSL

SEQ ID NO: 2530 - protein, 28 aa, Artificial Sequence
  Description of Artificial Sequence: Synthetic peptide
  N-terminus acetylated
  C-terminus amidated
DDPKLYDKDLGSAMTDTVVGWMDAAWSL

SEQ ID NO: 2531 - protein, 28 aa, Artificial Sequence
  Description of Artificial Sequence: Synthetic peptide
  N-terminus acetylated
DDPKLYDKDLGSAMTDTVVGWMDAAWSL

SEQ ID NO: 2532 - protein, 28 aa, Artificial Sequence
  Description of Artificial Sequence: Synthetic peptide
  N-terminus acetylated
  C-terminus amidated
DDPKLYDKDLGSAMTDTVVGWMDAATSL

SEQ ID NO: 2533 - protein, 28 aa, Artificial Sequence
  Description of Artificial Sequence: Synthetic peptide
  N-terminus acetylated
DDPKLYDKDLGSAMTDTVVGWMDAATSL

SEQ ID NO: 2534 - protein, 28 aa, Artificial Sequence
  Description of Artificial Sequence: Synthetic peptide
  N-terminus acetylated
  C-terminus amidated
DDPKLYDKDLGSAMTDTVVGQVDAAWSL

SEQ ID NO: 2535 - protein, 28 aa, Artificial Sequence
  Description of Artificial Sequence: Synthetic peptide
  N-terminus acetylated
DDPKLYDKDLGSAMTDTVVGQVDAAWSL

SEQ ID NO: 2536 - protein, 28 aa, Artificial Sequence
  Description of Artificial Sequence: Synthetic peptide
  N-terminus acetylated
  C-terminus amidated
DDPKLYDKDLGSAMTDTVVGQVDAATSL

SEQ ID NO: 2537 - protein, 28 aa, Artificial Sequence
  Description of Artificial Sequence: Synthetic peptide
  N-terminus acetylated
DDPKLYDKDLGSAMTDTVVGQVDAATSL

SEQ ID NO: 2538 - protein, 28 aa, Artificial Sequence
  Description of Artificial Sequence: Synthetic peptide
  N-terminus acetylated
  C-terminus amidated
DDPKLYDKDLGSAMTDTVVGQLDAAWSL

SEQ ID NO: 2539 - protein, 28 aa, Artificial Sequence
  Description of Artificial Sequence: Synthetic peptide
  N-terminus acetylated
DDPKLYDKDLGSAMTDTVVGQLDAAWSL

SEQ ID NO: 2540 - protein, 28 aa, Artificial Sequence
  Description of Artificial Sequence: Synthetic peptide
  N-terminus acetylated
  C-terminus amidated
DDPKLYDKDLGSAMTDTVVGQLDAATSL

SEQ ID NO: 2541 - protein, 28 aa, Artificial Sequence
  Description of Artificial Sequence: Synthetic peptide
  N-terminus acetylated
DDPKLYDKDLGSAMTDTVVGQLDAATSL

SEQ ID NO: 2542 - protein, 28 aa, Artificial Sequence
  Description of Artificial Sequence: Synthetic peptide
  N-terminus acetylated
  C-terminus amidated
DDPKLYDKDLGSAMTDTVVGQMDAAWSL

SEQ ID NO: 2543 - protein, 28 aa, Artificial Sequence
  Description of Artificial Sequence: Synthetic peptide
  N-terminus acetylated
DDPKLYDKDLGSAMTDTVVGQMDAAWSL

SEQ ID NO: 2544 - protein, 28 aa, Artificial Sequence
  Description of Artificial Sequence: Synthetic peptide
  N-terminus acetylated
  C-terminus amidated
DDPKLYDKDLGSAMTDTVVGQMDAATSL

SEQ ID NO: 2545 - protein, 28 aa, Artificial Sequence
  Description of Artificial Sequence: Synthetic peptide
  N-terminus acetylated
DDPKLYDKDLGSAMTDTVVGQMDAATSL

SEQ ID NO: 2546 - protein, 28 aa, Artificial Sequence
  Description of Artificial Sequence: Synthetic peptide
  N-terminus acetylated
  C-terminus amidated
DDPKLYDKDLGSAMGDWVVAWVDAAWSL

SEQ ID NO: 2547 - protein, 28 aa, Artificial Sequence
  Description of Artificial Sequence: Synthetic peptide
  N-terminus acetylated
DDPKLYDKDLGSAMGDWVVAWVDAAWSL

SEQ ID NO: 2548 - protein, 28 aa, Artificial Sequence
  Description of Artificial Sequence: Synthetic peptide
  N-terminus acetylated
  C-terminus amidated
DDPKLYDKDLGSAMGDWVVAWVDAATSL

SEQ ID NO: 2549 - protein, 28 aa, Artificial Sequence
  Description of Artificial Sequence: Synthetic peptide
  N-terminus acetylated
DDPKLYDKDLGSAMGDWVVAWVDAATSL

SEQ ID NO: 2550 - protein, 28 aa, Artificial Sequence
  Description of Artificial Sequence: Synthetic peptide
  N-terminus acetylated
  C-terminus amidated
DDPKLYDKDLGSAMGDWVVAWLDAAWSL

SEQ ID NO: 2551 - protein, 28 aa, Artificial Sequence
  Description of Artificial Sequence: Synthetic peptide
  N-terminus acetylated
DDPKLYDKDLGSAMGDWVVAWLDAAWSL

SEQ ID NO: 2552 - protein, 28 aa, Artificial Sequence
  Description of Artificial Sequence: Synthetic peptide
  N-terminus acetylated
  C-terminus amidated
DDPKLYDKDLGSAMGDWVVAWLDAATSL

SEQ ID NO: 2553 - protein, 28 aa, Artificial Sequence
  Description of Artificial Sequence: Synthetic peptide
  N-terminus acetylated
DDPKLYDKDLGSAMGDWVVAWLDAATSL

SEQ ID NO: 2554 - protein, 28 aa, Artificial Sequence
  Description of Artificial Sequence: Synthetic peptide
  N-terminus acetylated
  C-terminus amidated
DDPKLYDKDLGSAMGDWVVAWMDAAWSL

SEQ ID NO: 2555 - protein, 28 aa, Artificial Sequence
  Description of Artificial Sequence: Synthetic peptide
  N-terminus acetylated
DDPKLYDKDLGSAMGDWVVAWMDAAWSL

SEQ ID NO: 2556 - protein, 28 aa, Artificial Sequence
  Description of Artificial Sequence: Synthetic peptide
  N-terminus acetylated
  C-terminus amidated
DDPKLYDKDLGSAMGDWVVAWMDAATSL

SEQ ID NO: 2557 - protein, 28 aa, Artificial Sequence
  Description of Artificial Sequence: Synthetic peptide
  N-terminus acetylated
DDPKLYDKDLGSAMGDWVVAWMDAATSL

SEQ ID NO: 2558 - protein, 28 aa, Artificial Sequence
  Description of Artificial Sequence: Synthetic peptide
  N-terminus acetylated
  C-terminus amidated
DDPKLYDKDLGSAMGDWVVAQVDAAWSL

SEQ ID NO: 2559 - protein, 28 aa, Artificial Sequence
  Description of Artificial Sequence: Synthetic peptide
  N-terminus acetylated
DDPKLYDKDLGSAMGDWVVAQVDAAWSL

SEQ ID NO: 2560 - protein, 28 aa, Artificial Sequence
  Description of Artificial Sequence: Synthetic peptide
  N-terminus acetylated
  C-terminus amidated
DDPKLYDKDLGSAMGDWVVAQVDAATSL

SEQ ID NO: 2561 - protein, 28 aa, Artificial Sequence
  Description of Artificial Sequence: Synthetic peptide
  N-terminus acetylated
DDPKLYDKDLGSAMGDWVVAQVDAATSL

SEQ ID NO: 2562 - protein, 28 aa, Artificial Sequence
  Description of Artificial Sequence: Synthetic peptide
  N-terminus acetylated
  C-terminus amidated
DDPKLYDKDLGSAMGDWVVAQLDAAWSL

SEQ ID NO: 2563 - protein, 28 aa, Artificial Sequence
  Description of Artificial Sequence: Synthetic peptide
  N-terminus acetylated
DDPKLYDKDLGSAMGDWVVAQLDAAWSL

SEQ ID NO: 2564 - protein, 28 aa, Artificial Sequence
  Description of Artificial Sequence: Synthetic peptide
  N-terminus acetylated
  C-terminus amidated
DDPKLYDKDLGSAMGDWVVAQLDAATSL

SEQ ID NO: 2565 - protein, 28 aa, Artificial Sequence
  Description of Artificial Sequence: Synthetic peptide
  N-terminus acetylated
DDPKLYDKDLGSAMGDWVVAQLDAATSL

SEQ ID NO: 2566 - protein, 28 aa, Artificial Sequence
  Description of Artificial Sequence: Synthetic peptide
  N-terminus acetylated
  C-terminus amidated
DDPKLYDKDLGSAMGDWVVAQMDAAWSL

SEQ ID NO: 2567 - protein, 28 aa, Artificial Sequence
  Description of Artificial Sequence: Synthetic peptide
  N-terminus acetylated
DDPKLYDKDLGSAMGDWVVAQMDAAWSL

SEQ ID NO: 2568 - protein, 28 aa, Artificial Sequence
  Description of Artificial Sequence: Synthetic peptide
  N-terminus acetylated
  C-terminus amidated
DDPKLYDKDLGSAMGDWVVAQMDAATSL

SEQ ID NO: 2569 - protein, 28 aa, Artificial Sequence
  Description of Artificial Sequence: Synthetic peptide
  N-terminus acetylated
DDPKLYDKDLGSAMGDWVVAQMDAATSL

SEQ ID NO: 2570 - protein, 28 aa, Artificial Sequence
  Description of Artificial Sequence: Synthetic peptide
  N-terminus acetylated
  C-terminus amidated
DDPKLYDKDLGSAMGDWVVGWVDAAWSL

SEQ ID NO: 2571 - protein, 28 aa, Artificial Sequence
  Description of Artificial Sequence: Synthetic peptide
  N-terminus acetylated
DDPKLYDKDLGSAMGDWVVGWVDAAWSL

SEQ ID NO: 2572 - protein, 28 aa, Artificial Sequence
  Description of Artificial Sequence: Synthetic peptide
  N-terminus acetylated
  C-terminus amidated
DDPKLYDKDLGSAMGDWVVGWVDAATSL

SEQ ID NO: 2573 - protein, 28 aa, Artificial Sequence
  Description of Artificial Sequence: Synthetic peptide
  N-terminus acetylated
DDPKLYDKDLGSAMGDWVVGWVDAATSL

SEQ ID NO: 2574 - protein, 28 aa, Artificial Sequence
  Description of Artificial Sequence: Synthetic peptide
  N-terminus acetylated
  C-terminus amidated
DDPKLYDKDLGSAMGDWVVGWLDAAWSL

SEQ ID NO: 2575 - protein, 28 aa, Artificial Sequence
  Description of Artificial Sequence: Synthetic peptide
  N-terminus acetylated
DDPKLYDKDLGSAMGDWVVGWLDAAWSL

SEQ ID NO: 2576 - protein, 28 aa, Artificial Sequence
  Description of Artificial Sequence: Synthetic peptide
  N-terminus acetylated
  C-terminus amidated
DDPKLYDKDLGSAMGDWVVGWLDAATSL

SEQ ID NO: 2577 - protein, 28 aa, Artificial Sequence
  Description of Artificial Sequence: Synthetic peptide
  N-terminus acetylated
DDPKLYDKDLGSAMGDWVVGWLDAATSL

SEQ ID NO: 2578 - protein, 28 aa, Artificial Sequence
  Description of Artificial Sequence: Synthetic peptide
  N-terminus acetylated
  C-terminus amidated
DDPKLYDKDLGSAMGDWVVGWMDAAWSL

SEQ ID NO: 2579 - protein, 28 aa, Artificial Sequence
  Description of Artificial Sequence: Synthetic peptide
  N-terminus acetylated
DDPKLYDKDLGSAMGDWVVGWMDAAWSL

SEQ ID NO: 2580 - protein, 28 aa, Artificial Sequence
  Description of Artificial Sequence: Synthetic peptide
  N-terminus acetylated
  C-terminus amidated
DDPKLYDKDLGSAMGDWVVGWMDAATSL

SEQ ID NO: 2581 - protein, 28 aa, Artificial Sequence
  Description of Artificial Sequence: Synthetic peptide
  N-terminus acetylated
DDPKLYDKDLGSAMGDWVVGWMDAATSL

SEQ ID NO: 2582 - protein, 28 aa, Artificial Sequence
  Description of Artificial Sequence: Synthetic peptide
  N-terminus acetylated
  C-terminus amidated
DDPKLYDKDLGSAMGDWVVGQVDAAWSL

SEQ ID NO: 2583 - protein, 28 aa, Artificial Sequence
  Description of Artificial Sequence: Synthetic peptide
  N-terminus acetylated
DDPKLYDKDLGSAMGDWVVGQVDAAWSL

SEQ ID NO: 2584 - protein, 28 aa, Artificial Sequence
  Description of Artificial Sequence: Synthetic peptide
  N-terminus acetylated
  C-terminus amidated
DDPKLYDKDLGSAMGDWVVGQVDAATSL

SEQ ID NO: 2585 - protein, 28 aa, Artificial Sequence
  Description of Artificial Sequence: Synthetic peptide
  N-terminus acetylated
DDPKLYDKDLGSAMGDWVVGQVDAATSL

SEQ ID NO: 2586 - protein, 28 aa, Artificial Sequence
  Description of Artificial Sequence: Synthetic peptide
  N-terminus acetylated
  C-terminus amidated
DDPKLYDKDLGSAMGDWVVGQLDAAWSL

SEQ ID NO: 2587 - protein, 28 aa, Artificial Sequence
  Description of Artificial Sequence: Synthetic peptide
  N-terminus acetylated
DDPKLYDKDLGSAMGDWVVGQLDAAWSL

SEQ ID NO: 2588 - protein, 28 aa, Artificial Sequence
  Description of Artificial Sequence: Synthetic peptide
  N-terminus acetylated
  C-terminus amidated
DDPKLYDKDLGSAMGDWVVGQLDAATSL

SEQ ID NO: 2589 - protein, 28 aa, Artificial Sequence
  Description of Artificial Sequence: Synthetic peptide
  N-terminus acetylated
DDPKLYDKDLGSAMGDWVVGQLDAATSL

SEQ ID NO: 2590 - protein, 28 aa, Artificial Sequence
  Description of Artificial Sequence: Synthetic peptide
  N-terminus acetylated
  C-terminus amidated
DDPKLYDKDLGSAMGDWVVGQMDAAWSL

SEQ ID NO: 2591 - protein, 28 aa, Artificial Sequence
  Description of Artificial Sequence: Synthetic peptide
  N-terminus acetylated
DDPKLYDKDLGSAMGDWVVGQMDAAWSL

SEQ ID NO: 2592 - protein, 28 aa, Artificial Sequence
  Description of Artificial Sequence: Synthetic peptide
  N-terminus acetylated
  C-terminus amidated
DDPKLYDKDLGSAMGDWVVGQMDAATSL

SEQ ID NO: 2593 - protein, 28 aa, Artificial Sequence
  Description of Artificial Sequence: Synthetic peptide
  N-terminus acetylated
DDPKLYDKDLGSAMGDWVVGQMDAATSL

SEQ ID NO: 2594 - protein, 28 aa, Artificial Sequence
  Description of Artificial Sequence: Synthetic peptide
  N-terminus acetylated
  C-terminus amidated
DDPKLYDKDLGSAMGDTVVAWVDAAWSL

SEQ ID NO: 2595 - protein, 28 aa, Artificial Sequence
  Description of Artificial Sequence: Synthetic peptide
  N-terminus acetylated
DDPKLYDKDLGSAMGDTVVAWVDAAWSL

SEQ ID NO: 2596 - protein, 28 aa, Artificial Sequence
  Description of Artificial Sequence: Synthetic peptide
  N-terminus acetylated
  C-terminus amidated
DDPKLYDKDLGSAMGDTVVAWVDAATSL

SEQ ID NO: 2597 - protein, 28 aa, Artificial Sequence
  Description of Artificial Sequence: Synthetic peptide
  N-terminus acetylated
DDPKLYDKDLGSAMGDTVVAWVDAATSL

SEQ ID NO: 2598 - protein, 28 aa, Artificial Sequence
  Description of Artificial Sequence: Synthetic peptide
  N-terminus acetylated
  C-terminus amidated
DDPKLYDKDLGSAMGDTVVAWLDAAWSL

SEQ ID NO: 2599 - protein, 28 aa, Artificial Sequence
  Description of Artificial Sequence: Synthetic peptide
  N-terminus acetylated
DDPKLYDKDLGSAMGDTVVAWLDAAWSL

SEQ ID NO: 2600 - protein, 28 aa, Artificial Sequence
  Description of Artificial Sequence: Synthetic peptide
  N-terminus acetylated
  C-terminus amidated
DDPKLYDKDLGSAMGDTVVAWLDAATSL

SEQ ID NO: 2601 - protein, 28 aa, Artificial Sequence
  Description of Artificial Sequence: Synthetic peptide
  N-terminus acetylated
DDPKLYDKDLGSAMGDTVVAWLDAATSL

SEQ ID NO: 2602 - protein, 28 aa, Artificial Sequence
  Description of Artificial Sequence: Synthetic peptide
  N-terminus acetylated
  C-terminus amidated
DDPKLYDKDLGSAMGDTVVAWMDAAWSL

SEQ ID NO: 2603 - protein, 28 aa, Artificial Sequence
  Description of Artificial Sequence: Synthetic peptide
  N-terminus acetylated
DDPKLYDKDLGSAMGDTVVAWMDAAWSL

SEQ ID NO: 2604 - protein, 28 aa, Artificial Sequence
  Description of Artificial Sequence: Synthetic peptide
  N-terminus acetylated
  C-terminus amidated
DDPKLYDKDLGSAMGDTVVAWMDAATSL

SEQ ID NO: 2605 - protein, 28 aa, Artificial Sequence
  Description of Artificial Sequence: Synthetic peptide
  N-terminus acetylated
DDPKLYDKDLGSAMGDTVVAWMDAATSL

SEQ ID NO: 2606 - protein, 28 aa, Artificial Sequence
  Description of Artificial Sequence: Synthetic peptide
  N-terminus acetylated
  C-terminus amidated
DDPKLYDKDLGSAMGDTVVAQVDAAWSL

SEQ ID NO: 2607 - protein, 28 aa, Artificial Sequence
  Description of Artificial Sequence: Synthetic peptide
  N-terminus acetylated
DDPKLYDKDLGSAMGDTVVAQVDAAWSL

SEQ ID NO: 2608 - protein, 28 aa, Artificial Sequence
  Description of Artificial Sequence: Synthetic peptide
  N-terminus acetylated
  C-terminus amidated
DDPKLYDKDLGSAMGDTVVAQVDAATSL

SEQ ID NO: 2609 - protein, 28 aa, Artificial Sequence
  Description of Artificial Sequence: Synthetic peptide
  N-terminus acetylated
DDPKLYDKDLGSAMGDTVVAQVDAATSL

SEQ ID NO: 2610 - protein, 28 aa, Artificial Sequence
  Description of Artificial Sequence: Synthetic peptide
  N-terminus acetylated
  C-terminus amidated
DDPKLYDKDLGSAMGDTVVAQLDAAWSL

SEQ ID NO: 2611 - protein, 28 aa, Artificial Sequence
  Description of Artificial Sequence: Synthetic peptide
  N-terminus acetylated
DDPKLYDKDLGSAMGDTVVAQLDAAWSL

SEQ ID NO: 2612 - protein, 28 aa, Artificial Sequence
  Description of Artificial Sequence: Synthetic peptide
  N-terminus acetylated
  C-terminus amidated
DDPKLYDKDLGSAMGDTVVAQLDAATSL

SEQ ID NO: 2613 - protein, 28 aa, Artificial Sequence
  Description of Artificial Sequence: Synthetic peptide
  N-terminus acetylated
DDPKLYDKDLGSAMGDTVVAQLDAATSL

SEQ ID NO: 2614 - protein, 28 aa, Artificial Sequence
  Description of Artificial Sequence: Synthetic peptide
  N-terminus acetylated
  C-terminus amidated
DDPKLYDKDLGSAMGDTVVAQMDAAWSL

SEQ ID NO: 2615 - protein, 28 aa, Artificial Sequence
  Description of Artificial Sequence: Synthetic peptide
  N-terminus acetylated
DDPKLYDKDLGSAMGDTVVAQMDAAWSL

SEQ ID NO: 2616 - protein, 28 aa, Artificial Sequence
  Description of Artificial Sequence: Synthetic peptide
  N-terminus acetylated
  C-terminus amidated
DDPKLYDKDLGSAMGDTVVAQMDAATSL

SEQ ID NO: 2617 - protein, 28 aa, Artificial Sequence
  Description of Artificial Sequence: Synthetic peptide
  N-terminus acetylated
DDPKLYDKDLGSAMGDTVVAQMDAATSL

SEQ ID NO: 2618 - protein, 28 aa, Artificial Sequence
  Description of Artificial Sequence: Synthetic peptide
  N-terminus acetylated
  C-terminus amidated
DDPKLYDKDLGSAMGDTVVGWVDAAWSL

SEQ ID NO: 2619 - protein, 28 aa, Artificial Sequence
  Description of Artificial Sequence: Synthetic peptide
  N-terminus acetylated
DDPKLYDKDLGSAMGDTVVGWVDAAWSL

SEQ ID NO: 2620 - protein, 28 aa, Artificial Sequence
  Description of Artificial Sequence: Synthetic peptide
  N-terminus acetylated
  C-terminus amidated
DDPKLYDKDLGSAMGDTVVGWVDAATSL

SEQ ID NO: 2621 - protein, 28 aa, Artificial Sequence
  Description of Artificial Sequence: Synthetic peptide
  N-terminus acetylated
DDPKLYDKDLGSAMGDTVVGWVDAATSL

SEQ ID NO: 2622 - protein, 28 aa, Artificial Sequence
  Description of Artificial Sequence: Synthetic peptide
  N-terminus acetylated
  C-terminus amidated
DDPKLYDKDLGSAMGDTVVGWLDAAWSL

SEQ ID NO: 2623 - protein, 28 aa, Artificial Sequence
  Description of Artificial Sequence: Synthetic peptide
  N-terminus acetylated
DDPKLYDKDLGSAMGDTVVGWLDAAWSL

SEQ ID NO: 2624 - protein, 28 aa, Artificial Sequence
  Description of Artificial Sequence: Synthetic peptide
  N-terminus acetylated
  C-terminus amidated
DDPKLYDKDLGSAMGDTVVGWLDAATSL

SEQ ID NO: 2625 - protein, 28 aa, Artificial Sequence
  Description of Artificial Sequence: Synthetic peptide
  N-terminus acetylated
DDPKLYDKDLGSAMGDTVVGWLDAATSL

SEQ ID NO: 2626 - protein, 28 aa, Artificial Sequence
  Description of Artificial Sequence: Synthetic peptide
  N-terminus acetylated
  C-terminus amidated
DDPKLYDKDLGSAMGDTVVGWMDAAWSL

SEQ ID NO: 2627 - protein, 28 aa, Artificial Sequence
  Description of Artificial Sequence: Synthetic peptide
  N-terminus acetylated
DDPKLYDKDLGSAMGDTVVGWMDAAWSL

SEQ ID NO: 2628 - protein, 28 aa, Artificial Sequence
  Description of Artificial Sequence: Synthetic peptide
  N-terminus acetylated
  C-terminus amidated
DDPKLYDKDLGSAMGDTVVGWMDAATSL

SEQ ID NO: 2629 - protein, 28 aa, Artificial Sequence
  Description of Artificial Sequence: Synthetic peptide
  N-terminus acetylated
DDPKLYDKDLGSAMGDTVVGWMDAATSL

SEQ ID NO: 2630 - protein, 28 aa, Artificial Sequence
  Description of Artificial Sequence: Synthetic peptide
  N-terminus acetylated
  C-terminus amidated
DDPKLYDKDLGSAMGDTVVGQVDAAWSL

SEQ ID NO: 2631 - protein, 28 aa, Artificial Sequence
  Description of Artificial Sequence: Synthetic peptide
  N-terminus acetylated
DDPKLYDKDLGSAMGDTVVGQVDAAWSL

SEQ ID NO: 2632 - protein, 28 aa, Artificial Sequence
  Description of Artificial Sequence: Synthetic peptide
  N-terminus acetylated
  C-terminus amidated
DDPKLYDKDLGSAMGDTVVGQVDAATSL

SEQ ID NO: 2633 - protein, 28 aa, Artificial Sequence
  Description of Artificial Sequence: Synthetic peptide
  N-terminus acetylated
DDPKLYDKDLGSAMGDTVVGQVDAATSL

SEQ ID NO: 2634 - protein, 28 aa, Artificial Sequence
  Description of Artificial Sequence: Synthetic peptide
  N-terminus acetylated
  C-terminus amidated
DDPKLYDKDLGSAMGDTVVGQLDAAWSL

SEQ ID NO: 2635 - protein, 28 aa, Artificial Sequence
  Description of Artificial Sequence: Synthetic peptide
  N-terminus acetylated
DDPKLYDKDLGSAMGDTVVGQLDAAWSL

SEQ ID NO: 2636 - protein, 28 aa, Artificial Sequence
  Description of Artificial Sequence: Synthetic peptide
  N-terminus acetylated
  C-terminus amidated
DDPKLYDKDLGSAMGDTVVGQLDAATSL

SEQ ID NO: 2637 - protein, 28 aa, Artificial Sequence
  Description of Artificial Sequence: Synthetic peptide
  N-terminus acetylated
DDPKLYDKDLGSAMGDTVVGQLDAATSL

SEQ ID NO: 2638 - protein, 28 aa, Artificial Sequence
  Description of Artificial Sequence: Synthetic peptide
  N-terminus acetylated
  C-terminus amidated
DDPKLYDKDLGSAMGDTVVGQMDAAWSL

SEQ ID NO: 2639 - protein, 28 aa, Artificial Sequence
  Description of Artificial Sequence: Synthetic peptide
  N-terminus acetylated
DDPKLYDKDLGSAMGDTVVGQMDAAWSL

SEQ ID NO: 2640 - protein, 28 aa, Artificial Sequence
  Description of Artificial Sequence: Synthetic peptide
  N-terminus acetylated
  C-terminus amidated
DDPKLYDKDLGSAMGDTVVGQMDAATSL

SEQ ID NO: 2641 - protein, 28 aa, Artificial Sequence
  Description of Artificial Sequence: Synthetic peptide
  N-terminus acetylated
DDPKLYDKDLGSAMGDTVVGQMDAATSL

SEQ ID NO: 2642 - protein, 28 aa, Artificial Sequence
  Description of Artificial Sequence: Synthetic peptide
  C-terminus amidated
DDPKLYDKDLGSAVWDWVVAWVDAAWSL

SEQ ID NO: 2643 - protein, 28 aa, Artificial Sequence
  Description of Artificial Sequence: Synthetic peptide
DDPKLYDKDLGSAVWDWVVAWVDAAWSL

SEQ ID NO: 2644 - protein, 28 aa, Artificial Sequence
  Description of Artificial Sequence: Synthetic peptide
  C-terminus amidated
DDPKLYDKDLGSAVWDWVVAWVDAATSL

SEQ ID NO: 2645 - protein, 28 aa, Artificial Sequence
  Description of Artificial Sequence: Synthetic peptide
DDPKLYDKDLGSAVWDWVVAWVDAATSL

SEQ ID NO: 2646 - protein, 28 aa, Artificial Sequence
  Description of Artificial Sequence: Synthetic peptide
  C-terminus amidated
DDPKLYDKDLGSAVWDWVVAWLDAAWSL

SEQ ID NO: 2647 - protein, 28 aa, Artificial Sequence
  Description of Artificial Sequence: Synthetic peptide
DDPKLYDKDLGSAVWDWVVAWLDAAWSL

SEQ ID NO: 2648 - protein, 28 aa, Artificial Sequence
  Description of Artificial Sequence: Synthetic peptide
  C-terminus amidated
DDPKLYDKDLGSAVWDWVVAWLDAATSL

SEQ ID NO: 2649 - protein, 28 aa, Artificial Sequence
  Description of Artificial Sequence: Synthetic peptide
DDPKLYDKDLGSAVWDWVVAWLDAATSL

SEQ ID NO: 2650 - protein, 28 aa, Artificial Sequence
  Description of Artificial Sequence: Synthetic peptide
  C-terminus amidated
DDPKLYDKDLGSAVWDWVVAWMDAAWSL

SEQ ID NO: 2651 - protein, 28 aa, Artificial Sequence
  Description of Artificial Sequence: Synthetic peptide
DDPKLYDKDLGSAVWDWVVAWMDAAWSL

SEQ ID NO: 2652 - protein, 28 aa, Artificial Sequence
  Description of Artificial Sequence: Synthetic peptide
  C-terminus amidated
DDPKLYDKDLGSAVWDWVVAWMDAATSL

SEQ ID NO: 2653 - protein, 28 aa, Artificial Sequence
  Description of Artificial Sequence: Synthetic peptide
DDPKLYDKDLGSAVWDWVVAWMDAATSL

SEQ ID NO: 2654 - protein, 28 aa, Artificial Sequence
  Description of Artificial Sequence: Synthetic peptide
  C-terminus amidated
DDPKLYDKDLGSAVWDWVVAQVDAAWSL

SEQ ID NO: 2655 - protein, 28 aa, Artificial Sequence
  Description of Artificial Sequence: Synthetic peptide
DDPKLYDKDLGSAVWDWVVAQVDAAWSL

SEQ ID NO: 2656 - protein, 28 aa, Artificial Sequence
  Description of Artificial Sequence: Synthetic peptide
  C-terminus amidated
DDPKLYDKDLGSAVWDWVVAQVDAATSL

SEQ ID NO: 2657 - protein, 28 aa, Artificial Sequence
  Description of Artificial Sequence: Synthetic peptide
DDPKLYDKDLGSAVWDWVVAQVDAATSL

SEQ ID NO: 2658 - protein, 28 aa, Artificial Sequence
  Description of Artificial Sequence: Synthetic peptide
  C-terminus amidated
DDPKLYDKDLGSAVWDWVVAQLDAAWSL

SEQ ID NO: 2659 - protein, 28 aa, Artificial Sequence
  Description of Artificial Sequence: Synthetic peptide
DDPKLYDKDLGSAVWDWVVAQLDAAWSL

SEQ ID NO: 2660 - protein, 28 aa, Artificial Sequence
  Description of Artificial Sequence: Synthetic peptide
  C-terminus amidated
DDPKLYDKDLGSAVWDWVVAQLDAATSL

SEQ ID NO: 2661 - protein, 28 aa, Artificial Sequence
  Description of Artificial Sequence: Synthetic peptide
DDPKLYDKDLGSAVWDWVVAQLDAATSL

SEQ ID NO: 2662 - protein, 28 aa, Artificial Sequence
  Description of Artificial Sequence: Synthetic peptide
  C-terminus amidated
DDPKLYDKDLGSAVWDWVVAQMDAAWSL

SEQ ID NO: 2663 - protein, 28 aa, Artificial Sequence
  Description of Artificial Sequence: Synthetic peptide
DDPKLYDKDLGSAVWDWVVAQMDAAWSL

SEQ ID NO: 2664 - protein, 28 aa, Artificial Sequence
  Description of Artificial Sequence: Synthetic peptide
  C-terminus amidated
DDPKLYDKDLGSAVWDWVVAQMDAATSL

SEQ ID NO: 2665 - protein, 28 aa, Artificial Sequence
  Description of Artificial Sequence: Synthetic peptide
DDPKLYDKDLGSAVWDWVVAQMDAATSL

SEQ ID NO: 2666 - protein, 28 aa, Artificial Sequence
  Description of Artificial Sequence: Synthetic peptide
  C-terminus amidated
DDPKLYDKDLGSAVWDWVVGWVDAAWSL

SEQ ID NO: 2667 - protein, 28 aa, Artificial Sequence
  Description of Artificial Sequence: Synthetic peptide
DDPKLYDKDLGSAVWDWVVGWVDAAWSL

SEQ ID NO: 2668 - protein, 28 aa, Artificial Sequence
  Description of Artificial Sequence: Synthetic peptide
  C-terminus amidated
DDPKLYDKDLGSAVWDWVVGWVDAATSL

SEQ ID NO: 2669 - protein, 28 aa, Artificial Sequence
  Description of Artificial Sequence: Synthetic peptide
DDPKLYDKDLGSAVWDWVVGWVDAATSL

SEQ ID NO: 2670 - protein, 28 aa, Artificial Sequence
  Description of Artificial Sequence: Synthetic peptide
  C-terminus amidated
DDPKLYDKDLGSAVWDWVVGWLDAAWSL

SEQ ID NO: 2671 - protein, 28 aa, Artificial Sequence
  Description of Artificial Sequence: Synthetic peptide
DDPKLYDKDLGSAVWDWVVGWLDAAWSL

SEQ ID NO: 2672 - protein, 28 aa, Artificial Sequence
  Description of Artificial Sequence: Synthetic peptide
  C-terminus amidated
DDPKLYDKDLGSAVWDWVVGWLDAATSL

SEQ ID NO: 2673 - protein, 28 aa, Artificial Sequence
  Description of Artificial Sequence: Synthetic peptide
DDPKLYDKDLGSAVWDWVVGWLDAATSL

SEQ ID NO: 2674 - protein, 28 aa, Artificial Sequence
  Description of Artificial Sequence: Synthetic peptide
  C-terminus amidated
DDPKLYDKDLGSAVWDWVVGWMDAAWSL

SEQ ID NO: 2675 - protein, 28 aa, Artificial Sequence
  Description of Artificial Sequence: Synthetic peptide
DDPKLYDKDLGSAVWDWVVGWMDAAWSL

SEQ ID NO: 2676 - protein, 28 aa, Artificial Sequence
  Description of Artificial Sequence: Synthetic peptide
  C-terminus amidated
DDPKLYDKDLGSAVWDWVVGWMDAATSL

SEQ ID NO: 2677 - protein, 28 aa, Artificial Sequence
  Description of Artificial Sequence: Synthetic peptide
DDPKLYDKDLGSAVWDWVVGWMDAATSL

SEQ ID NO: 2678 - protein, 28 aa, Artificial Sequence
  Description of Artificial Sequence: Synthetic peptide
  C-terminus amidated
DDPKLYDKDLGSAVWDWVVGQVDAAWSL

SEQ ID NO: 2679 - protein, 28 aa, Artificial Sequence
  Description of Artificial Sequence: Synthetic peptide
DDPKLYDKDLGSAVWDWVVGQVDAAWSL

SEQ ID NO: 2680 - protein, 28 aa, Artificial Sequence
  Description of Artificial Sequence: Synthetic peptide
  C-terminus amidated
DDPKLYDKDLGSAVWDWVVGQVDAATSL

SEQ ID NO: 2681 - protein, 28 aa, Artificial Sequence
  Description of Artificial Sequence: Synthetic peptide
DDPKLYDKDLGSAVWDWVVGQVDAATSL

SEQ ID NO: 2682 - protein, 28 aa, Artificial Sequence
  Description of Artificial Sequence: Synthetic peptide
  C-terminus amidated
DDPKLYDKDLGSAVWDWVVGQLDAAWSL

SEQ ID NO: 2683 - protein, 28 aa, Artificial Sequence
  Description of Artificial Sequence: Synthetic peptide
DDPKLYDKDLGSAVWDWVVGQLDAAWSL

SEQ ID NO: 2684 - protein, 28 aa, Artificial Sequence
  Description of Artificial Sequence: Synthetic peptide
  C-terminus amidated
DDPKLYDKDLGSAVWDWVVGQLDAATSL

SEQ ID NO: 2685 - protein, 28 aa, Artificial Sequence
  Description of Artificial Sequence: Synthetic peptide
DDPKLYDKDLGSAVWDWVVGQLDAATSL

SEQ ID NO: 2686 - protein, 28 aa, Artificial Sequence
  Description of Artificial Sequence: Synthetic peptide
  C-terminus amidated
DDPKLYDKDLGSAVWDWVVGQMDAAWSL

SEQ ID NO: 2687 - protein, 28 aa, Artificial Sequence
  Description of Artificial Sequence: Synthetic peptide
DDPKLYDKDLGSAVWDWVVGQMDAAWSL

SEQ ID NO: 2688 - protein, 28 aa, Artificial Sequence
  Description of Artificial Sequence: Synthetic peptide
  C-terminus amidated
DDPKLYDKDLGSAVWDWVVGQMDAATSL

SEQ ID NO: 2689 - protein, 28 aa, Artificial Sequence
  Description of Artificial Sequence: Synthetic peptide
DDPKLYDKDLGSAVWDWVVGQMDAATSL

SEQ ID NO: 2690 - protein, 28 aa, Artificial Sequence
  Description of Artificial Sequence: Synthetic peptide
  C-terminus amidated
DDPKLYDKDLGSAVWDTVVAWVDAAWSL

SEQ ID NO: 2691 - protein, 28 aa, Artificial Sequence
  Description of Artificial Sequence: Synthetic peptide
DDPKLYDKDLGSAVWDTVVAWVDAAWSL

SEQ ID NO: 2692 - protein, 28 aa, Artificial Sequence
  Description of Artificial Sequence: Synthetic peptide
  C-terminus amidated
DDPKLYDKDLGSAVWDTVVAWVDAATSL

SEQ ID NO: 2693 - protein, 28 aa, Artificial Sequence
  Description of Artificial Sequence: Synthetic peptide
DDPKLYDKDLGSAVWDTVVAWVDAATSL

SEQ ID NO: 2694 - protein, 28 aa, Artificial Sequence
  Description of Artificial Sequence: Synthetic peptide
  C-terminus amidated
DDPKLYDKDLGSAVWDTVVAWLDAAWSL

SEQ ID NO: 2695 - protein, 28 aa, Artificial Sequence
  Description of Artificial Sequence: Synthetic peptide
DDPKLYDKDLGSAVWDTVVAWLDAAWSL

SEQ ID NO: 2696 - protein, 28 aa, Artificial Sequence
  Description of Artificial Sequence: Synthetic peptide
  C-terminus amidated
DDPKLYDKDLGSAVWDTVVAWLDAATSL

SEQ ID NO: 2697 - protein, 28 aa, Artificial Sequence
  Description of Artificial Sequence: Synthetic peptide
DDPKLYDKDLGSAVWDTVVAWLDAATSL

SEQ ID NO: 2698 - protein, 28 aa, Artificial Sequence
  Description of Artificial Sequence: Synthetic peptide
  C-terminus amidated
DDPKLYDKDLGSAVWDTVVAWMDAAWSL

SEQ ID NO: 2699 - protein, 28 aa, Artificial Sequence
  Description of Artificial Sequence: Synthetic peptide
DDPKLYDKDLGSAVWDTVVAWMDAAWSL

SEQ ID NO: 2700 - protein, 28 aa, Artificial Sequence
  Description of Artificial Sequence: Synthetic peptide
  C-terminus amidated
DDPKLYDKDLGSAVWDTVVAWMDAATSL

SEQ ID NO: 2701 - protein, 28 aa, Artificial Sequence
  Description of Artificial Sequence: Synthetic peptide
DDPKLYDKDLGSAVWDTVVAWMDAATSL

SEQ ID NO: 2702 - protein, 28 aa, Artificial Sequence
  Description of Artificial Sequence: Synthetic peptide
  C-terminus amidated
DDPKLYDKDLGSAVWDTVVAQVDAAWSL

SEQ ID NO: 2703 - protein, 28 aa, Artificial Sequence
  Description of Artificial Sequence: Synthetic peptide
DDPKLYDKDLGSAVWDTVVAQVDAAWSL

SEQ ID NO: 2704 - protein, 28 aa, Artificial Sequence
  Description of Artificial Sequence: Synthetic peptide
  C-terminus amidated
DDPKLYDKDLGSAVWDTVVAQVDAATSL

SEQ ID NO: 2705 - protein, 28 aa, Artificial Sequence
  Description of Artificial Sequence: Synthetic peptide
DDPKLYDKDLGSAVWDTVVAQVDAATSL

SEQ ID NO: 2706 - protein, 28 aa, Artificial Sequence
  Description of Artificial Sequence: Synthetic peptide
  C-terminus amidated
DDPKLYDKDLGSAVWDTVVAQLDAAWSL

SEQ ID NO: 2707 - protein, 28 aa, Artificial Sequence
  Description of Artificial Sequence: Synthetic peptide
DDPKLYDKDLGSAVWDTVVAQLDAAWSL

SEQ ID NO: 2708 - protein, 28 aa, Artificial Sequence
  Description of Artificial Sequence: Synthetic peptide
  C-terminus amidated
DDPKLYDKDLGSAVWDTVVAQLDAATSL

SEQ ID NO: 2709 - protein, 28 aa, Artificial Sequence
  Description of Artificial Sequence: Synthetic peptide
DDPKLYDKDLGSAVWDTVVAQLDAATSL

SEQ ID NO: 2710 - protein, 28 aa, Artificial Sequence
  Description of Artificial Sequence: Synthetic peptide
  C-terminus amidated
DDPKLYDKDLGSAVWDTVVAQMDAAWSL

SEQ ID NO: 2711 - protein, 28 aa, Artificial Sequence
  Description of Artificial Sequence: Synthetic peptide
DDPKLYDKDLGSAVWDTVVAQMDAAWSL

SEQ ID NO: 2712 - protein, 28 aa, Artificial Sequence
  Description of Artificial Sequence: Synthetic peptide
  C-terminus amidated
DDPKLYDKDLGSAVWDTVVAQMDAATSL

SEQ ID NO: 2713 - protein, 28 aa, Artificial Sequence
  Description of Artificial Sequence: Synthetic peptide
DDPKLYDKDLGSAVWDTVVAQMDAATSL

SEQ ID NO: 2714 - protein, 28 aa, Artificial Sequence
  Description of Artificial Sequence: Synthetic peptide
  C-terminus amidated
DDPKLYDKDLGSAVWDTVVGWVDAAWSL

SEQ ID NO: 2715 - protein, 28 aa, Artificial Sequence
  Description of Artificial Sequence: Synthetic peptide
DDPKLYDKDLGSAVWDTVVGWVDAAWSL

SEQ ID NO: 2716 - protein, 28 aa, Artificial Sequence
  Description of Artificial Sequence: Synthetic peptide
  C-terminus amidated
DDPKLYDKDLGSAVWDTVVGWVDAATSL

SEQ ID NO: 2717 - protein, 28 aa, Artificial Sequence
  Description of Artificial Sequence: Synthetic peptide
DDPKLYDKDLGSAVWDTVVGWVDAATSL

SEQ ID NO: 2718 - protein, 28 aa, Artificial Sequence
  Description of Artificial Sequence: Synthetic peptide
  C-terminus amidated
DDPKLYDKDLGSAVWDTVVGWLDAAWSL

SEQ ID NO: 2719 - protein, 28 aa, Artificial Sequence
  Description of Artificial Sequence: Synthetic peptide
DDPKLYDKDLGSAVWDTVVGWLDAAWSL

SEQ ID NO: 2720 - protein, 28 aa, Artificial Sequence
  Description of Artificial Sequence: Synthetic peptide
  C-terminus amidated
DDPKLYDKDLGSAVWDTVVGWLDAATSL

SEQ ID NO: 2721 - protein, 28 aa, Artificial Sequence
  Description of Artificial Sequence: Synthetic peptide
DDPKLYDKDLGSAVWDTVVGWLDAATSL

SEQ ID NO: 2722 - protein, 28 aa, Artificial Sequence
  Description of Artificial Sequence: Synthetic peptide
  C-terminus amidated
DDPKLYDKDLGSAVWDTVVGWMDAAWSL

SEQ ID NO: 2723 - protein, 28 aa, Artificial Sequence
  Description of Artificial Sequence: Synthetic peptide
DDPKLYDKDLGSAVWDTVVGWMDAAWSL

SEQ ID NO: 2724 - protein, 28 aa, Artificial Sequence
  Description of Artificial Sequence: Synthetic peptide
  C-terminus amidated
DDPKLYDKDLGSAVWDTVVGWMDAATSL

SEQ ID NO: 2725 - protein, 28 aa, Artificial Sequence
  Description of Artificial Sequence: Synthetic peptide
DDPKLYDKDLGSAVWDTVVGWMDAATSL

SEQ ID NO: 2726 - protein, 28 aa, Artificial Sequence
  Description of Artificial Sequence: Synthetic peptide
  C-terminus amidated
DDPKLYDKDLGSAVWDTVVGQVDAAWSL

SEQ ID NO: 2727 - protein, 28 aa, Artificial Sequence
  Description of Artificial Sequence: Synthetic peptide
DDPKLYDKDLGSAVWDTVVGQVDAAWSL

SEQ ID NO: 2728 - protein, 28 aa, Artificial Sequence
  Description of Artificial Sequence: Synthetic peptide
  C-terminus amidated
DDPKLYDKDLGSAVWDTVVGQVDAATSL

SEQ ID NO: 2729 - protein, 28 aa, Artificial Sequence
  Description of Artificial Sequence: Synthetic peptide
DDPKLYDKDLGSAVWDTVVGQVDAATSL

SEQ ID NO: 2730 - protein, 28 aa, Artificial Sequence
  Description of Artificial Sequence: Synthetic peptide
  C-terminus amidated
DDPKLYDKDLGSAVWDTVVGQLDAAWSL

SEQ ID NO: 2731 - protein, 28 aa, Artificial Sequence
  Description of Artificial Sequence: Synthetic peptide
DDPKLYDKDLGSAVWDTVVGQLDAAWSL

SEQ ID NO: 2732 - protein, 28 aa, Artificial Sequence
  Description of Artificial Sequence: Synthetic peptide
  C-terminus amidated
DDPKLYDKDLGSAVWDTVVGQLDAATSL

SEQ ID NO: 2733 - protein, 28 aa, Artificial Sequence
  Description of Artificial Sequence: Synthetic peptide
DDPKLYDKDLGSAVWDTVVGQLDAATSL

SEQ ID NO: 2734 - protein, 28 aa, Artificial Sequence
  Description of Artificial Sequence: Synthetic peptide
  C-terminus amidated
DDPKLYDKDLGSAVWDTVVGQMDAAWSL

SEQ ID NO: 2735 - protein, 28 aa, Artificial Sequence
  Description of Artificial Sequence: Synthetic peptide
DDPKLYDKDLGSAVWDTVVGQMDAAWSL

SEQ ID NO: 2736 - protein, 28 aa, Artificial Sequence
  Description of Artificial Sequence: Synthetic peptide
  C-terminus amidated
DDPKLYDKDLGSAVWDTVVGQMDAATSL

SEQ ID NO: 2737 - protein, 28 aa, Artificial Sequence
  Description of Artificial Sequence: Synthetic peptide
DDPKLYDKDLGSAVWDTVVGQMDAATSL

SEQ ID NO: 2738 - protein, 28 aa, Artificial Sequence
  Description of Artificial Sequence: Synthetic peptide
  C-terminus amidated
DDPKLYDKDLGSAVTDWVVAWVDAAWSL

SEQ ID NO: 2739 - protein, 28 aa, Artificial Sequence
  Description of Artificial Sequence: Synthetic peptide
DDPKLYDKDLGSAVTDWVVAWVDAAWSL

SEQ ID NO: 2740 - protein, 28 aa, Artificial Sequence
  Description of Artificial Sequence: Synthetic peptide
  C-terminus amidated
DDPKLYDKDLGSAVTDWVVAWVDAATSL

SEQ ID NO: 2741 - protein, 28 aa, Artificial Sequence
  Description of Artificial Sequence: Synthetic peptide
DDPKLYDKDLGSAVTDWVVAWVDAATSL

SEQ ID NO: 2742 - protein, 28 aa, Artificial Sequence
  Description of Artificial Sequence: Synthetic peptide
  C-terminus amidated
DDPKLYDKDLGSAVTDWVVAWLDAAWSL

SEQ ID NO: 2743 - protein, 28 aa, Artificial Sequence
  Description of Artificial Sequence: Synthetic peptide
DDPKLYDKDLGSAVTDWVVAWLDAAWSL

SEQ ID NO: 2744 - protein, 28 aa, Artificial Sequence
  Description of Artificial Sequence: Synthetic peptide
  C-terminus amidated
DDPKLYDKDLGSAVTDWVVAWLDAATSL

SEQ ID NO: 2745 - protein, 28 aa, Artificial Sequence
  Description of Artificial Sequence: Synthetic peptide
DDPKLYDKDLGSAVTDWVVAWLDAATSL

SEQ ID NO: 2746 - protein, 28 aa, Artificial Sequence
  Description of Artificial Sequence: Synthetic peptide
  C-terminus amidated
DDPKLYDKDLGSAVTDWVVAWMDAAWSL

SEQ ID NO: 2747 - protein, 28 aa, Artificial Sequence
  Description of Artificial Sequence: Synthetic peptide
DDPKLYDKDLGSAVTDWVVAWMDAAWSL

SEQ ID NO: 2748 - protein, 28 aa, Artificial Sequence
  Description of Artificial Sequence: Synthetic peptide
  C-terminus amidated
DDPKLYDKDLGSAVTDWVVAWMDAATSL

SEQ ID NO: 2749 - protein, 28 aa, Artificial Sequence
  Description of Artificial Sequence: Synthetic peptide
DDPKLYDKDLGSAVTDWVVAWMDAATSL

SEQ ID NO: 2750 - protein, 28 aa, Artificial Sequence
  Description of Artificial Sequence: Synthetic peptide
  C-terminus amidated
DDPKLYDKDLGSAVTDWVVAQVDAAWSL

SEQ ID NO: 2751 - protein, 28 aa, Artificial Sequence
  Description of Artificial Sequence: Synthetic peptide
DDPKLYDKDLGSAVTDWVVAQVDAAWSL

SEQ ID NO: 2752 - protein, 28 aa, Artificial Sequence
  Description of Artificial Sequence: Synthetic peptide
  C-terminus amidated
DDPKLYDKDLGSAVTDWVVAQVDAATSL

SEQ ID NO: 2753 - protein, 28 aa, Artificial Sequence
  Description of Artificial Sequence: Synthetic peptide
DDPKLYDKDLGSAVTDWVVAQVDAATSL

SEQ ID NO: 2754 - protein, 28 aa, Artificial Sequence
  Description of Artificial Sequence: Synthetic peptide
  C-terminus amidated
DDPKLYDKDLGSAVTDWVVAQLDAAWSL

SEQ ID NO: 2755 - protein, 28 aa, Artificial Sequence
  Description of Artificial Sequence: Synthetic peptide
DDPKLYDKDLGSAVTDWVVAQLDAAWSL

SEQ ID NO: 2756 - protein, 28 aa, Artificial Sequence
  Description of Artificial Sequence: Synthetic peptide
  C-terminus amidated
DDPKLYDKDLGSAVTDWVVAQLDAATSL

SEQ ID NO: 2757 - protein, 28 aa, Artificial Sequence
  Description of Artificial Sequence: Synthetic peptide
DDPKLYDKDLGSAVTDWVVAQLDAATSL

SEQ ID NO: 2758 - protein, 28 aa, Artificial Sequence
  Description of Artificial Sequence: Synthetic peptide
  C-terminus amidated
DDPKLYDKDLGSAVTDWVVAQMDAAWSL

SEQ ID NO: 2759 - protein, 28 aa, Artificial Sequence
  Description of Artificial Sequence: Synthetic peptide
DDPKLYDKDLGSAVTDWVVAQMDAAWSL

SEQ ID NO: 2760 - protein, 28 aa, Artificial Sequence
  Description of Artificial Sequence: Synthetic peptide
  C-terminus amidated
DDPKLYDKDLGSAVTDWVVAQMDAATSL

SEQ ID NO: 2761 - protein, 28 aa, Artificial Sequence
  Description of Artificial Sequence: Synthetic peptide
DDPKLYDKDLGSAVTDWVVAQMDAATSL

SEQ ID NO: 2762 - protein, 28 aa, Artificial Sequence
  Description of Artificial Sequence: Synthetic peptide
  C-terminus amidated
DDPKLYDKDLGSAVTDWVVGWVDAAWSL

SEQ ID NO: 2763 - protein, 28 aa, Artificial Sequence
  Description of Artificial Sequence: Synthetic peptide
DDPKLYDKDLGSAVTDWVVGWVDAAWSL

SEQ ID NO: 2764 - protein, 28 aa, Artificial Sequence
  Description of Artificial Sequence: Synthetic peptide
  C-terminus amidated
DDPKLYDKDLGSAVTDWVVGWVDAATSL

SEQ ID NO: 2765 - protein, 28 aa, Artificial Sequence
  Description of Artificial Sequence: Synthetic peptide
DDPKLYDKDLGSAVTDWVVGWVDAATSL

SEQ ID NO: 2766 - protein, 28 aa, Artificial Sequence
  Description of Artificial Sequence: Synthetic peptide
  C-terminus amidated
DDPKLYDKDLGSAVTDWVVGWLDAAWSL

SEQ ID NO: 2767 - protein, 28 aa, Artificial Sequence
  Description of Artificial Sequence: Synthetic peptide
DDPKLYDKDLGSAVTDWVVGWLDAAWSL

SEQ ID NO: 2768 - protein, 28 aa, Artificial Sequence
  Description of Artificial Sequence: Synthetic peptide
  C-terminus amidated
DDPKLYDKDLGSAVTDWVVGWLDAATSL

SEQ ID NO: 2769 - protein, 28 aa, Artificial Sequence
  Description of Artificial Sequence: Synthetic peptide
DDPKLYDKDLGSAVTDWVVGWLDAATSL

SEQ ID NO: 2770 - protein, 28 aa, Artificial Sequence
  Description of Artificial Sequence: Synthetic peptide
  C-terminus amidated
DDPKLYDKDLGSAVTDWVVGWMDAAWSL

SEQ ID NO: 2771 - protein, 28 aa, Artificial Sequence
  Description of Artificial Sequence: Synthetic peptide
DDPKLYDKDLGSAVTDWVVGWMDAAWSL

SEQ ID NO: 2772 - protein, 28 aa, Artificial Sequence
  Description of Artificial Sequence: Synthetic peptide
  C-terminus amidated
DDPKLYDKDLGSAVTDWVVGWMDAATSL

SEQ ID NO: 2773 - protein, 28 aa, Artificial Sequence
  Description of Artificial Sequence: Synthetic peptide
DDPKLYDKDLGSAVTDWVVGWMDAATSL

SEQ ID NO: 2774 - protein, 28 aa, Artificial Sequence
  Description of Artificial Sequence: Synthetic peptide
  C-terminus amidated
DDPKLYDKDLGSAVTDWVVGQVDAAWSL

SEQ ID NO: 2775 - protein, 28 aa, Artificial Sequence
  Description of Artificial Sequence: Synthetic peptide
DDPKLYDKDLGSAVTDWVVGQVDAAWSL

SEQ ID NO: 2776 - protein, 28 aa, Artificial Sequence
  Description of Artificial Sequence: Synthetic peptide
  C-terminus amidated
DDPKLYDKDLGSAVTDWVVGQVDAATSL

SEQ ID NO: 2777 - protein, 28 aa, Artificial Sequence
  Description of Artificial Sequence: Synthetic peptide
DDPKLYDKDLGSAVTDWVVGQVDAATSL

SEQ ID NO: 2778 - protein, 28 aa, Artificial Sequence
  Description of Artificial Sequence: Synthetic peptide
  C-terminus amidated
DDPKLYDKDLGSAVTDWVVGQLDAAWSL

SEQ ID NO: 2779 - protein, 28 aa, Artificial Sequence
  Description of Artificial Sequence: Synthetic peptide
DDPKLYDKDLGSAVTDWVVGQLDAAWSL

SEQ ID NO: 2780 - protein, 28 aa, Artificial Sequence
  Description of Artificial Sequence: Synthetic peptide
  C-terminus amidated
DDPKLYDKDLGSAVTDWVVGQLDAATSL

SEQ ID NO: 2781 - protein, 28 aa, Artificial Sequence
  Description of Artificial Sequence: Synthetic peptide
DDPKLYDKDLGSAVTDWVVGQLDAATSL

SEQ ID NO: 2782 - protein, 28 aa, Artificial Sequence
  Description of Artificial Sequence: Synthetic peptide
  C-terminus amidated
DDPKLYDKDLGSAVTDWVVGQMDAAWSL

SEQ ID NO: 2783 - protein, 28 aa, Artificial Sequence
  Description of Artificial Sequence: Synthetic peptide
DDPKLYDKDLGSAVTDWVVGQMDAAWSL

SEQ ID NO: 2784 - protein, 28 aa, Artificial Sequence
  Description of Artificial Sequence: Synthetic peptide
  C-terminus amidated
DDPKLYDKDLGSAVTDWVVGQMDAATSL

SEQ ID NO: 2785 - protein, 28 aa, Artificial Sequence
  Description of Artificial Sequence: Synthetic peptide
DDPKLYDKDLGSAVTDWVVGQMDAATSL

SEQ ID NO: 2786 - protein, 28 aa, Artificial Sequence
  Description of Artificial Sequence: Synthetic peptide
  C-terminus amidated
DDPKLYDKDLGSAVTDTVVAWVDAAWSL

SEQ ID NO: 2787 - protein, 28 aa, Artificial Sequence
  Description of Artificial Sequence: Synthetic peptide
DDPKLYDKDLGSAVTDTVVAWVDAAWSL

SEQ ID NO: 2788 - protein, 28 aa, Artificial Sequence
  Description of Artificial Sequence: Synthetic peptide
  C-terminus amidated
DDPKLYDKDLGSAVTDTVVAWVDAATSL

SEQ ID NO: 2789 - protein, 28 aa, Artificial Sequence
  Description of Artificial Sequence: Synthetic peptide
DDPKLYDKDLGSAVTDTVVAWVDAATSL

SEQ ID NO: 2790 - protein, 28 aa, Artificial Sequence
  Description of Artificial Sequence: Synthetic peptide
  C-terminus amidated
DDPKLYDKDLGSAVTDTVVAWLDAAWSL

SEQ ID NO: 2791 - protein, 28 aa, Artificial Sequence
  Description of Artificial Sequence: Synthetic peptide
DDPKLYDKDLGSAVTDTVVAWLDAAWSL

SEQ ID NO: 2792 - protein, 28 aa, Artificial Sequence
  Description of Artificial Sequence: Synthetic peptide
  C-terminus amidated
DDPKLYDKDLGSAVTDTVVAWLDAATSL

SEQ ID NO: 2793 - protein, 28 aa, Artificial Sequence
  Description of Artificial Sequence: Synthetic peptide
DDPKLYDKDLGSAVTDTVVAWLDAATSL

SEQ ID NO: 2794 - protein, 28 aa, Artificial Sequence
  Description of Artificial Sequence: Synthetic peptide
  C-terminus amidated
DDPKLYDKDLGSAVTDTVVAWMDAAWSL

SEQ ID NO: 2795 - protein, 28 aa, Artificial Sequence
  Description of Artificial Sequence: Synthetic peptide
DDPKLYDKDLGSAVTDTVVAWMDAAWSL

SEQ ID NO: 2796 - protein, 28 aa, Artificial Sequence
  Description of Artificial Sequence: Synthetic peptide
  C-terminus amidated
DDPKLYDKDLGSAVTDTVVAWMDAATSL

SEQ ID NO: 2797 - protein, 28 aa, Artificial Sequence
  Description of Artificial Sequence: Synthetic peptide
DDPKLYDKDLGSAVTDTVVAWMDAATSL

SEQ ID NO: 2798 - protein, 28 aa, Artificial Sequence
  Description of Artificial Sequence: Synthetic peptide
  C-terminus amidated
DDPKLYDKDLGSAVTDTVVAQVDAAWSL

SEQ ID NO: 2799 - protein, 28 aa, Artificial Sequence
  Description of Artificial Sequence: Synthetic peptide
DDPKLYDKDLGSAVTDTVVAQVDAAWSL

SEQ ID NO: 2800 - protein, 28 aa, Artificial Sequence
  Description of Artificial Sequence: Synthetic peptide
  C-terminus amidated
DDPKLYDKDLGSAVTDTVVAQVDAATSL

SEQ ID NO: 2801 - protein, 28 aa, Artificial Sequence
  Description of Artificial Sequence: Synthetic peptide
DDPKLYDKDLGSAVTDTVVAQVDAATSL

SEQ ID NO: 2802 - protein, 28 aa, Artificial Sequence
  Description of Artificial Sequence: Synthetic peptide
  C-terminus amidated
DDPKLYDKDLGSAVTDTVVAQLDAAWSL

SEQ ID NO: 2803 - protein, 28 aa, Artificial Sequence
  Description of Artificial Sequence: Synthetic peptide
DDPKLYDKDLGSAVTDTVVAQLDAAWSL

SEQ ID NO: 2804 - protein, 28 aa, Artificial Sequence
  Description of Artificial Sequence: Synthetic peptide
  C-terminus amidated
DDPKLYDKDLGSAVTDTVVAQLDAATSL

SEQ ID NO: 2805 - protein, 28 aa, Artificial Sequence
  Description of Artificial Sequence: Synthetic peptide
DDPKLYDKDLGSAVTDTVVAQLDAATSL

SEQ ID NO: 2806 - protein, 28 aa, Artificial Sequence
  Description of Artificial Sequence: Synthetic peptide
  C-terminus amidated
DDPKLYDKDLGSAVTDTVVAQMDAAWSL

SEQ ID NO: 2807 - protein, 28 aa, Artificial Sequence
  Description of Artificial Sequence: Synthetic peptide
DDPKLYDKDLGSAVTDTVVAQMDAAWSL

SEQ ID NO: 2808 - protein, 28 aa, Artificial Sequence
  Description of Artificial Sequence: Synthetic peptide
  C-terminus amidated
DDPKLYDKDLGSAVTDTVVAQMDAATSL

SEQ ID NO: 2809 - protein, 28 aa, Artificial Sequence
  Description of Artificial Sequence: Synthetic peptide
DDPKLYDKDLGSAVTDTVVAQMDAATSL

SEQ ID NO: 2810 - protein, 28 aa, Artificial Sequence
  Description of Artificial Sequence: Synthetic peptide
  C-terminus amidated
DDPKLYDKDLGSAVTDTVVGWVDAAWSL

SEQ ID NO: 2811 - protein, 28 aa, Artificial Sequence
  Description of Artificial Sequence: Synthetic peptide
DDPKLYDKDLGSAVTDTVVGWVDAAWSL

SEQ ID NO: 2812 - protein, 28 aa, Artificial Sequence
  Description of Artificial Sequence: Synthetic peptide
  C-terminus amidated
DDPKLYDKDLGSAVTDTVVGWVDAATSL

SEQ ID NO: 2813 - protein, 28 aa, Artificial Sequence
  Description of Artificial Sequence: Synthetic peptide
DDPKLYDKDLGSAVTDTVVGWVDAATSL

SEQ ID NO: 2814 - protein, 28 aa, Artificial Sequence
  Description of Artificial Sequence: Synthetic peptide
  C-terminus amidated
DDPKLYDKDLGSAVTDTVVGWLDAAWSL

SEQ ID NO: 2815 - protein, 28 aa, Artificial Sequence
  Description of Artificial Sequence: Synthetic peptide
DDPKLYDKDLGSAVTDTVVGWLDAAWSL

SEQ ID NO: 2816 - protein, 28 aa, Artificial Sequence
  Description of Artificial Sequence: Synthetic peptide
  C-terminus amidated
DDPKLYDKDLGSAVTDTVVGWLDAATSL

SEQ ID NO: 2817 - protein, 28 aa, Artificial Sequence
  Description of Artificial Sequence: Synthetic peptide
DDPKLYDKDLGSAVTDTVVGWLDAATSL

SEQ ID NO: 2818 - protein, 28 aa, Artificial Sequence
  Description of Artificial Sequence: Synthetic peptide
  C-terminus amidated
DDPKLYDKDLGSAVTDTVVGWMDAAWSL

SEQ ID NO: 2819 - protein, 28 aa, Artificial Sequence
  Description of Artificial Sequence: Synthetic peptide
DDPKLYDKDLGSAVTDTVVGWMDAAWSL

SEQ ID NO: 2820 - protein, 28 aa, Artificial Sequence
  Description of Artificial Sequence: Synthetic peptide
  C-terminus amidated
DDPKLYDKDLGSAVTDTVVGWMDAATSL

SEQ ID NO: 2821 - protein, 28 aa, Artificial Sequence
  Description of Artificial Sequence: Synthetic peptide
DDPKLYDKDLGSAVTDTVVGWMDAATSL

SEQ ID NO: 2822 - protein, 28 aa, Artificial Sequence
  Description of Artificial Sequence: Synthetic peptide
  C-terminus amidated
DDPKLYDKDLGSAVTDTVVGQVDAAWSL

SEQ ID NO: 2823 - protein, 28 aa, Artificial Sequence
  Description of Artificial Sequence: Synthetic peptide
DDPKLYDKDLGSAVTDTVVGQVDAAWSL

SEQ ID NO: 2824 - protein, 28 aa, Artificial Sequence
  Description of Artificial Sequence: Synthetic peptide
  C-terminus amidated
DDPKLYDKDLGSAVTDTVVGQVDAATSL

SEQ ID NO: 2825 - protein, 28 aa, Artificial Sequence
  Description of Artificial Sequence: Synthetic peptide
DDPKLYDKDLGSAVTDTVVGQVDAATSL

SEQ ID NO: 2826 - protein, 28 aa, Artificial Sequence
  Description of Artificial Sequence: Synthetic peptide
  C-terminus amidated
DDPKLYDKDLGSAVTDTVVGQLDAAWSL

SEQ ID NO: 2827 - protein, 28 aa, Artificial Sequence
  Description of Artificial Sequence: Synthetic peptide
DDPKLYDKDLGSAVTDTVVGQLDAAWSL

SEQ ID NO: 2828 - protein, 28 aa, Artificial Sequence
  Description of Artificial Sequence: Synthetic peptide
  C-terminus amidated
DDPKLYDKDLGSAVTDTVVGQLDAATSL

SEQ ID NO: 2829 - protein, 28 aa, Artificial Sequence
  Description of Artificial Sequence: Synthetic peptide
DDPKLYDKDLGSAVTDTVVGQLDAATSL

SEQ ID NO: 2830 - protein, 28 aa, Artificial Sequence
  Description of Artificial Sequence: Synthetic peptide
  C-terminus amidated
DDPKLYDKDLGSAVTDTVVGQMDAAWSL

SEQ ID NO: 2831 - protein, 28 aa, Artificial Sequence
  Description of Artificial Sequence: Synthetic peptide
DDPKLYDKDLGSAVTDTVVGQMDAAWSL

SEQ ID NO: 2832 - protein, 28 aa, Artificial Sequence
  Description of Artificial Sequence: Synthetic peptide
  C-terminus amidated
DDPKLYDKDLGSAVTDTVVGQMDAATSL

SEQ ID NO: 2833 - protein, 28 aa, Artificial Sequence
  Description of Artificial Sequence: Synthetic peptide
DDPKLYDKDLGSAVTDTVVGQMDAATSL

SEQ ID NO: 2834 - protein, 28 aa, Artificial Sequence
  Description of Artificial Sequence: Synthetic peptide
  C-terminus amidated
DDPKLYDKDLGSAVGDWVVAWVDAAWSL

SEQ ID NO: 2835 - protein, 28 aa, Artificial Sequence
  Description of Artificial Sequence: Synthetic peptide
DDPKLYDKDLGSAVGDWVVAWVDAAWSL

SEQ ID NO: 2836 - protein, 28 aa, Artificial Sequence
  Description of Artificial Sequence: Synthetic peptide
  C-terminus amidated
DDPKLYDKDLGSAVGDWVVAWVDAATSL

SEQ ID NO: 2837 - protein, 28 aa, Artificial Sequence
  Description of Artificial Sequence: Synthetic peptide
DDPKLYDKDLGSAVGDWVVAWVDAATSL

SEQ ID NO: 2838 - protein, 28 aa, Artificial Sequence
  Description of Artificial Sequence: Synthetic peptide
  C-terminus amidated
DDPKLYDKDLGSAVGDWVVAWLDAAWSL

SEQ ID NO: 2839 - protein, 28 aa, Artificial Sequence
  Description of Artificial Sequence: Synthetic peptide
DDPKLYDKDLGSAVGDWVVAWLDAAWSL

SEQ ID NO: 2840 - protein, 28 aa, Artificial Sequence
  Description of Artificial Sequence: Synthetic peptide
  C-terminus amidated
DDPKLYDKDLGSAVGDWVVAWLDAATSL

SEQ ID NO: 2841 - protein, 28 aa, Artificial Sequence
  Description of Artificial Sequence: Synthetic peptide
DDPKLYDKDLGSAVGDWVVAWLDAATSL

SEQ ID NO: 2842 - protein, 28 aa, Artificial Sequence
  Description of Artificial Sequence: Synthetic peptide
  C-terminus amidated
DDPKLYDKDLGSAVGDWVVAWMDAAWSL

SEQ ID NO: 2843 - protein, 28 aa, Artificial Sequence
  Description of Artificial Sequence: Synthetic peptide
DDPKLYDKDLGSAVGDWVVAWMDAAWSL

SEQ ID NO: 2844 - protein, 28 aa, Artificial Sequence
  Description of Artificial Sequence: Synthetic peptide
  C-terminus amidated
DDPKLYDKDLGSAVGDWVVAWMDAATSL

SEQ ID NO: 2845 - protein, 28 aa, Artificial Sequence
  Description of Artificial Sequence: Synthetic peptide
DDPKLYDKDLGSAVGDWVVAWMDAATSL

SEQ ID NO: 2846 - protein, 28 aa, Artificial Sequence
  Description of Artificial Sequence: Synthetic peptide
  C-terminus amidated
DDPKLYDKDLGSAVGDWVVAQVDAAWSL

SEQ ID NO: 2847 - protein, 28 aa, Artificial Sequence
  Description of Artificial Sequence: Synthetic peptide
DDPKLYDKDLGSAVGDWVVAQVDAAWSL

SEQ ID NO: 2848 - protein, 28 aa, Artificial Sequence
  Description of Artificial Sequence: Synthetic peptide
  C-terminus amidated
DDPKLYDKDLGSAVGDWVVAQVDAATSL

SEQ ID NO: 2849 - protein, 28 aa, Artificial Sequence
  Description of Artificial Sequence: Synthetic peptide
DDPKLYDKDLGSAVGDWVVAQVDAATSL

SEQ ID NO: 2850 - protein, 28 aa, Artificial Sequence
  Description of Artificial Sequence: Synthetic peptide
  C-terminus amidated
DDPKLYDKDLGSAVGDWVVAQLDAAWSL

SEQ ID NO: 2851 - protein, 28 aa, Artificial Sequence
  Description of Artificial Sequence: Synthetic peptide
DDPKLYDKDLGSAVGDWVVAQLDAAWSL

SEQ ID NO: 2852 - protein, 28 aa, Artificial Sequence
  Description of Artificial Sequence: Synthetic peptide
  C-terminus amidated
DDPKLYDKDLGSAVGDWVVAQLDAATSL

SEQ ID NO: 2853 - protein, 28 aa, Artificial Sequence
  Description of Artificial Sequence: Synthetic peptide
DDPKLYDKDLGSAVGDWVVAQLDAATSL

SEQ ID NO: 2854 - protein, 28 aa, Artificial Sequence
  Description of Artificial Sequence: Synthetic peptide
  C-terminus amidated
DDPKLYDKDLGSAVGDWVVAQMDAAWSL

SEQ ID NO: 2855 - protein, 28 aa, Artificial Sequence
  Description of Artificial Sequence: Synthetic peptide
DDPKLYDKDLGSAVGDWVVAQMDAAWSL

SEQ ID NO: 2856 - protein, 28 aa, Artificial Sequence
  Description of Artificial Sequence: Synthetic peptide
  C-terminus amidated
DDPKLYDKDLGSAVGDWVVAQMDAATSL

SEQ ID NO: 2857 - protein, 28 aa, Artificial Sequence
  Description of Artificial Sequence: Synthetic peptide
DDPKLYDKDLGSAVGDWVVAQMDAATSL

SEQ ID NO: 2858 - protein, 28 aa, Artificial Sequence
  Description of Artificial Sequence: Synthetic peptide
  C-terminus amidated
DDPKLYDKDLGSAVGDWVVGWVDAAWSL

SEQ ID NO: 2859 - protein, 28 aa, Artificial Sequence
  Description of Artificial Sequence: Synthetic peptide
DDPKLYDKDLGSAVGDWVVGWVDAAWSL

SEQ ID NO: 2860 - protein, 28 aa, Artificial Sequence
  Description of Artificial Sequence: Synthetic peptide
  C-terminus amidated
DDPKLYDKDLGSAVGDWVVGWVDAATSL

SEQ ID NO: 2861 - protein, 28 aa, Artificial Sequence
  Description of Artificial Sequence: Synthetic peptide
DDPKLYDKDLGSAVGDWVVGWVDAATSL

SEQ ID NO: 2862 - protein, 28 aa, Artificial Sequence
  Description of Artificial Sequence: Synthetic peptide
  C-terminus amidated
DDPKLYDKDLGSAVGDWVVGWLDAAWSL

SEQ ID NO: 2863 - protein, 28 aa, Artificial Sequence
  Description of Artificial Sequence: Synthetic peptide
DDPKLYDKDLGSAVGDWVVGWLDAAWSL

SEQ ID NO: 2864 - protein, 28 aa, Artificial Sequence
  Description of Artificial Sequence: Synthetic peptide
  C-terminus amidated
DDPKLYDKDLGSAVGDWVVGWLDAATSL

SEQ ID NO: 2865 - protein, 28 aa, Artificial Sequence
  Description of Artificial Sequence: Synthetic peptide
DDPKLYDKDLGSAVGDWVVGWLDAATSL

SEQ ID NO: 2866 - protein, 28 aa, Artificial Sequence
  Description of Artificial Sequence: Synthetic peptide
  C-terminus amidated
DDPKLYDKDLGSAVGDWVVGWMDAAWSL

SEQ ID NO: 2867 - protein, 28 aa, Artificial Sequence
  Description of Artificial Sequence: Synthetic peptide
DDPKLYDKDLGSAVGDWVVGWMDAAWSL

SEQ ID NO: 2868 - protein, 28 aa, Artificial Sequence
  Description of Artificial Sequence: Synthetic peptide
  C-terminus amidated
DDPKLYDKDLGSAVGDWVVGWMDAATSL

SEQ ID NO: 2869 - protein, 28 aa, Artificial Sequence
  Description of Artificial Sequence: Synthetic peptide
DDPKLYDKDLGSAVGDWVVGWMDAATSL

SEQ ID NO: 2870 - protein, 28 aa, Artificial Sequence
  Description of Artificial Sequence: Synthetic peptide
  C-terminus amidated
DDPKLYDKDLGSAVGDWVVGQVDAAWSL

SEQ ID NO: 2871 - protein, 28 aa, Artificial Sequence
  Description of Artificial Sequence: Synthetic peptide
DDPKLYDKDLGSAVGDWVVGQVDAAWSL

SEQ ID NO: 2872 - protein, 28 aa, Artificial Sequence
  Description of Artificial Sequence: Synthetic peptide
  C-terminus amidated
DDPKLYDKDLGSAVGDWVVGQVDAATSL

SEQ ID NO: 2873 - protein, 28 aa, Artificial Sequence
  Description of Artificial Sequence: Synthetic peptide
DDPKLYDKDLGSAVGDWVVGQVDAATSL

SEQ ID NO: 2874 - protein, 28 aa, Artificial Sequence
  Description of Artificial Sequence: Synthetic peptide
  C-terminus amidated
DDPKLYDKDLGSAVGDWVVGQLDAAWSL

SEQ ID NO: 2875 - protein, 28 aa, Artificial Sequence
  Description of Artificial Sequence: Synthetic peptide
DDPKLYDKDLGSAVGDWVVGQLDAAWSL

SEQ ID NO: 2876 - protein, 28 aa, Artificial Sequence
  Description of Artificial Sequence: Synthetic peptide
  C-terminus amidated
DDPKLYDKDLGSAVGDWVVGQLDAATSL

SEQ ID NO: 2877 - protein, 28 aa, Artificial Sequence
  Description of Artificial Sequence: Synthetic peptide
DDPKLYDKDLGSAVGDWVVGQLDAATSL

SEQ ID NO: 2878 - protein, 28 aa, Artificial Sequence
  Description of Artificial Sequence: Synthetic peptide
  C-terminus amidated
DDPKLYDKDLGSAVGDWVVGQMDAAWSL

SEQ ID NO: 2879 - protein, 28 aa, Artificial Sequence
  Description of Artificial Sequence: Synthetic peptide
DDPKLYDKDLGSAVGDWVVGQMDAAWSL

SEQ ID NO: 2880 - protein, 28 aa, Artificial Sequence
  Description of Artificial Sequence: Synthetic peptide
  C-terminus amidated
DDPKLYDKDLGSAVGDWVVGQMDAATSL

SEQ ID NO: 2881 - protein, 28 aa, Artificial Sequence
  Description of Artificial Sequence: Synthetic peptide
DDPKLYDKDLGSAVGDWVVGQMDAATSL

SEQ ID NO: 2882 - protein, 28 aa, Artificial Sequence
  Description of Artificial Sequence: Synthetic peptide
  C-terminus amidated
DDPKLYDKDLGSAVGDTVVAWVDAAWSL

SEQ ID NO: 2883 - protein, 28 aa, Artificial Sequence
  Description of Artificial Sequence: Synthetic peptide
DDPKLYDKDLGSAVGDTVVAWVDAAWSL

SEQ ID NO: 2884 - protein, 28 aa, Artificial Sequence
  Description of Artificial Sequence: Synthetic peptide
  C-terminus amidated
DDPKLYDKDLGSAVGDTVVAWVDAATSL

SEQ ID NO: 2885 - protein, 28 aa, Artificial Sequence
  Description of Artificial Sequence: Synthetic peptide
DDPKLYDKDLGSAVGDTVVAWVDAATSL

SEQ ID NO: 2886 - protein, 28 aa, Artificial Sequence
  Description of Artificial Sequence: Synthetic peptide
  C-terminus amidated
DDPKLYDKDLGSAVGDTVVAWLDAAWSL

SEQ ID NO: 2887 - protein, 28 aa, Artificial Sequence
  Description of Artificial Sequence: Synthetic peptide
DDPKLYDKDLGSAVGDTVVAWLDAAWSL

SEQ ID NO: 2888 - protein, 28 aa, Artificial Sequence
  Description of Artificial Sequence: Synthetic peptide
  C-terminus amidated
DDPKLYDKDLGSAVGDTVVAWLDAATSL

SEQ ID NO: 2889 - protein, 28 aa, Artificial Sequence
  Description of Artificial Sequence: Synthetic peptide
DDPKLYDKDLGSAVGDTVVAWLDAATSL

SEQ ID NO: 2890 - protein, 28 aa, Artificial Sequence
  Description of Artificial Sequence: Synthetic peptide
  C-terminus amidated
DDPKLYDKDLGSAVGDTVVAWMDAAWSL

SEQ ID NO: 2891 - protein, 28 aa, Artificial Sequence
  Description of Artificial Sequence: Synthetic peptide
DDPKLYDKDLGSAVGDTVVAWMDAAWSL

SEQ ID NO: 2892 - protein, 28 aa, Artificial Sequence
  Description of Artificial Sequence: Synthetic peptide
  C-terminus amidated
DDPKLYDKDLGSAVGDTVVAWMDAATSL

SEQ ID NO: 2893 - protein, 28 aa, Artificial Sequence
  Description of Artificial Sequence: Synthetic peptide
DDPKLYDKDLGSAVGDTVVAWMDAATSL

SEQ ID NO: 2894 - protein, 28 aa, Artificial Sequence
  Description of Artificial Sequence: Synthetic peptide
  C-terminus amidated
DDPKLYDKDLGSAVGDTVVAQVDAAWSL

SEQ ID NO: 2895 - protein, 28 aa, Artificial Sequence
  Description of Artificial Sequence: Synthetic peptide
DDPKLYDKDLGSAVGDTVVAQVDAAWSL

SEQ ID NO: 2896 - protein, 28 aa, Artificial Sequence
  Description of Artificial Sequence: Synthetic peptide
  C-terminus amidated
DDPKLYDKDLGSAVGDTVVAQVDAATSL

SEQ ID NO: 2897 - protein, 28 aa, Artificial Sequence
  Description of Artificial Sequence: Synthetic peptide
DDPKLYDKDLGSAVGDTVVAQVDAATSL

SEQ ID NO: 2898 - protein, 28 aa, Artificial Sequence
  Description of Artificial Sequence: Synthetic peptide
  C-terminus amidated
DDPKLYDKDLGSAVGDTVVAQLDAAWSL

SEQ ID NO: 2899 - protein, 28 aa, Artificial Sequence
  Description of Artificial Sequence: Synthetic peptide
DDPKLYDKDLGSAVGDTVVAQLDAAWSL

SEQ ID NO: 2900 - protein, 28 aa, Artificial Sequence
  Description of Artificial Sequence: Synthetic peptide
  C-terminus amidated
DDPKLYDKDLGSAVGDTVVAQLDAATSL

SEQ ID NO: 2901 - protein, 28 aa, Artificial Sequence
  Description of Artificial Sequence: Synthetic peptide
DDPKLYDKDLGSAVGDTVVAQLDAATSL

SEQ ID NO: 2902 - protein, 28 aa, Artificial Sequence
  Description of Artificial Sequence: Synthetic peptide
  C-terminus amidated
DDPKLYDKDLGSAVGDTVVAQMDAAWSL

SEQ ID NO: 2903 - protein, 28 aa, Artificial Sequence
  Description of Artificial Sequence: Synthetic peptide
DDPKLYDKDLGSAVGDTVVAQMDAAWSL

SEQ ID NO: 2904 - protein, 28 aa, Artificial Sequence
  Description of Artificial Sequence: Synthetic peptide
  C-terminus amidated
DDPKLYDKDLGSAVGDTVVAQMDAATSL

SEQ ID NO: 2905 - protein, 28 aa, Artificial Sequence
  Description of Artificial Sequence: Synthetic peptide
DDPKLYDKDLGSAVGDTVVAQMDAATSL

SEQ ID NO: 2906 - protein, 28 aa, Artificial Sequence
  Description of Artificial Sequence: Synthetic peptide
  C-terminus amidated
DDPKLYDKDLGSAVGDTVVGWVDAAWSL

SEQ ID NO: 2907 - protein, 28 aa, Artificial Sequence
  Description of Artificial Sequence: Synthetic peptide
DDPKLYDKDLGSAVGDTVVGWVDAAWSL

SEQ ID NO: 2908 - protein, 28 aa, Artificial Sequence
  Description of Artificial Sequence: Synthetic peptide
  C-terminus amidated
DDPKLYDKDLGSAVGDTVVGWVDAATSL

SEQ ID NO: 2909 - protein, 28 aa, Artificial Sequence
  Description of Artificial Sequence: Synthetic peptide
DDPKLYDKDLGSAVGDTVVGWVDAATSL

SEQ ID NO: 2910 - protein, 28 aa, Artificial Sequence
  Description of Artificial Sequence: Synthetic peptide
  C-terminus amidated
DDPKLYDKDLGSAVGDTVVGWLDAAWSL

SEQ ID NO: 2911 - protein, 28 aa, Artificial Sequence
  Description of Artificial Sequence: Synthetic peptide
DDPKLYDKDLGSAVGDTVVGWLDAAWSL

SEQ ID NO: 2912 - protein, 28 aa, Artificial Sequence
  Description of Artificial Sequence: Synthetic peptide
  C-terminus amidated
DDPKLYDKDLGSAVGDTVVGWLDAATSL

SEQ ID NO: 2913 - protein, 28 aa, Artificial Sequence
  Description of Artificial Sequence: Synthetic peptide
DDPKLYDKDLGSAVGDTVVGWLDAATSL

SEQ ID NO: 2914 - protein, 28 aa, Artificial Sequence
  Description of Artificial Sequence: Synthetic peptide
  C-terminus amidated
DDPKLYDKDLGSAVGDTVVGWMDAAWSL

SEQ ID NO: 2915 - protein, 28 aa, Artificial Sequence
  Description of Artificial Sequence: Synthetic peptide
DDPKLYDKDLGSAVGDTVVGWMDAAWSL

SEQ ID NO: 2916 - protein, 28 aa, Artificial Sequence
  Description of Artificial Sequence: Synthetic peptide
  C-terminus amidated
DDPKLYDKDLGSAVGDTVVGWMDAATSL

SEQ ID NO: 2917 - protein, 28 aa, Artificial Sequence
  Description of Artificial Sequence: Synthetic peptide
DDPKLYDKDLGSAVGDTVVGWMDAATSL

SEQ ID NO: 2918 - protein, 28 aa, Artificial Sequence
  Description of Artificial Sequence: Synthetic peptide
  C-terminus amidated
DDPKLYDKDLGSAVGDTVVGQVDAAWSL

SEQ ID NO: 2919 - protein, 28 aa, Artificial Sequence
  Description of Artificial Sequence: Synthetic peptide
DDPKLYDKDLGSAVGDTVVGQVDAAWSL

SEQ ID NO: 2920 - protein, 28 aa, Artificial Sequence
  Description of Artificial Sequence: Synthetic peptide
  C-terminus amidated
DDPKLYDKDLGSAVGDTVVGQVDAATSL

SEQ ID NO: 2921 - protein, 28 aa, Artificial Sequence
  Description of Artificial Sequence: Synthetic peptide
DDPKLYDKDLGSAVGDTVVGQVDAATSL

SEQ ID NO: 2922 - protein, 28 aa, Artificial Sequence
  Description of Artificial Sequence: Synthetic peptide
  C-terminus amidated
DDPKLYDKDLGSAVGDTVVGQLDAAWSL

SEQ ID NO: 2923 - protein, 28 aa, Artificial Sequence
  Description of Artificial Sequence: Synthetic peptide
DDPKLYDKDLGSAVGDTVVGQLDAAWSL

SEQ ID NO: 2924 - protein, 28 aa, Artificial Sequence
  Description of Artificial Sequence: Synthetic peptide
  C-terminus amidated
DDPKLYDKDLGSAVGDTVVGQLDAATSL

SEQ ID NO: 2925 - protein, 28 aa, Artificial Sequence
  Description of Artificial Sequence: Synthetic peptide
DDPKLYDKDLGSAVGDTVVGQLDAATSL

SEQ ID NO: 2926 - protein, 28 aa, Artificial Sequence
  Description of Artificial Sequence: Synthetic peptide
  C-terminus amidated
DDPKLYDKDLGSAVGDTVVGQMDAAWSL

SEQ ID NO: 2927 - protein, 28 aa, Artificial Sequence
  Description of Artificial Sequence: Synthetic peptide
DDPKLYDKDLGSAVGDTVVGQMDAAWSL

SEQ ID NO: 2928 - protein, 28 aa, Artificial Sequence
  Description of Artificial Sequence: Synthetic peptide
  C-terminus amidated
DDPKLYDKDLGSAVGDTVVGQMDAATSL

SEQ ID NO: 2929 - protein, 28 aa, Artificial Sequence
  Description of Artificial Sequence: Synthetic peptide
DDPKLYDKDLGSAVGDTVVGQMDAATSL

SEQ ID NO: 2930 - protein, 28 aa, Artificial Sequence
  Description of Artificial Sequence: Synthetic peptide
  C-terminus amidated
DDPKLYDKDLGSALWDWVVAWVDAAWSL

SEQ ID NO: 2931 - protein, 28 aa, Artificial Sequence
  Description of Artificial Sequence: Synthetic peptide
DDPKLYDKDLGSALWDWVVAWVDAAWSL

SEQ ID NO: 2932 - protein, 28 aa, Artificial Sequence
  Description of Artificial Sequence: Synthetic peptide
  C-terminus amidated
DDPKLYDKDLGSALWDWVVAWVDAATSL

SEQ ID NO: 2933 - protein, 28 aa, Artificial Sequence
  Description of Artificial Sequence: Synthetic peptide
DDPKLYDKDLGSALWDWVVAWVDAATSL

SEQ ID NO: 2934 - protein, 28 aa, Artificial Sequence
  Description of Artificial Sequence: Synthetic peptide
  C-terminus amidated
DDPKLYDKDLGSALWDWVVAWLDAAWSL

SEQ ID NO: 2935 - protein, 28 aa, Artificial Sequence
  Description of Artificial Sequence: Synthetic peptide
DDPKLYDKDLGSALWDWVVAWLDAAWSL

SEQ ID NO: 2936 - protein, 28 aa, Artificial Sequence
  Description of Artificial Sequence: Synthetic peptide
  C-terminus amidated
DDPKLYDKDLGSALWDWVVAWLDAATSL

SEQ ID NO: 2937 - protein, 28 aa, Artificial Sequence
  Description of Artificial Sequence: Synthetic peptide
DDPKLYDKDLGSALWDWVVAWLDAATSL

SEQ ID NO: 2938 - protein, 28 aa, Artificial Sequence
  Description of Artificial Sequence: Synthetic peptide
  C-terminus amidated
DDPKLYDKDLGSALWDWVVAWMDAAWSL

SEQ ID NO: 2939 - protein, 28 aa, Artificial Sequence
  Description of Artificial Sequence: Synthetic peptide
DDPKLYDKDLGSALWDWVVAWMDAAWSL

SEQ ID NO: 2940 - protein, 28 aa, Artificial Sequence
  Description of Artificial Sequence: Synthetic peptide
  C-terminus amidated
DDPKLYDKDLGSALWDWVVAWMDAATSL

SEQ ID NO: 2941 - protein, 28 aa, Artificial Sequence
  Description of Artificial Sequence: Synthetic peptide
DDPKLYDKDLGSALWDWVVAWMDAATSL

SEQ ID NO: 2942 - protein, 28 aa, Artificial Sequence
  Description of Artificial Sequence: Synthetic peptide
  C-terminus amidated
DDPKLYDKDLGSALWDWVVAQVDAAWSL

SEQ ID NO: 2943 - protein, 28 aa, Artificial Sequence
  Description of Artificial Sequence: Synthetic peptide
DDPKLYDKDLGSALWDWVVAQVDAAWSL

SEQ ID NO: 2944 - protein, 28 aa, Artificial Sequence
  Description of Artificial Sequence: Synthetic peptide
  C-terminus amidated
DDPKLYDKDLGSALWDWVVAQVDAATSL

SEQ ID NO: 2945 - protein, 28 aa, Artificial Sequence
  Description of Artificial Sequence: Synthetic peptide
DDPKLYDKDLGSALWDWVVAQVDAATSL

SEQ ID NO: 2946 - protein, 28 aa, Artificial Sequence
  Description of Artificial Sequence: Synthetic peptide
  C-terminus amidated
DDPKLYDKDLGSALWDWVVAQLDAAWSL

SEQ ID NO: 2947 - protein, 28 aa, Artificial Sequence
  Description of Artificial Sequence: Synthetic peptide
DDPKLYDKDLGSALWDWVVAQLDAAWSL

SEQ ID NO: 2948 - protein, 28 aa, Artificial Sequence
  Description of Artificial Sequence: Synthetic peptide
  C-terminus amidated
DDPKLYDKDLGSALWDWVVAQLDAATSL

SEQ ID NO: 2949 - protein, 28 aa, Artificial Sequence
  Description of Artificial Sequence: Synthetic peptide
DDPKLYDKDLGSALWDWVVAQLDAATSL

SEQ ID NO: 2950 - protein, 28 aa, Artificial Sequence
  Description of Artificial Sequence: Synthetic peptide
  C-terminus amidated
DDPKLYDKDLGSALWDWVVAQMDAAWSL

SEQ ID NO: 2951 - protein, 28 aa, Artificial Sequence
  Description of Artificial Sequence: Synthetic peptide
DDPKLYDKDLGSALWDWVVAQMDAAWSL

SEQ ID NO: 2952 - protein, 28 aa, Artificial Sequence
  Description of Artificial Sequence: Synthetic peptide
  C-terminus amidated
DDPKLYDKDLGSALWDWVVAQMDAATSL

SEQ ID NO: 2953 - protein, 28 aa, Artificial Sequence
  Description of Artificial Sequence: Synthetic peptide
DDPKLYDKDLGSALWDWVVAQMDAATSL

SEQ ID NO: 2954 - protein, 28 aa, Artificial Sequence
  Description of Artificial Sequence: Synthetic peptide
  C-terminus amidated
DDPKLYDKDLGSALWDWVVGWVDAAWSL

SEQ ID NO: 2955 - protein, 28 aa, Artificial Sequence
  Description of Artificial Sequence: Synthetic peptide
DDPKLYDKDLGSALWDWVVGWVDAAWSL

SEQ ID NO: 2956 - protein, 28 aa, Artificial Sequence
  Description of Artificial Sequence: Synthetic peptide
  C-terminus amidated
DDPKLYDKDLGSALWDWVVGWVDAATSL

SEQ ID NO: 2957 - protein, 28 aa, Artificial Sequence
  Description of Artificial Sequence: Synthetic peptide
DDPKLYDKDLGSALWDWVVGWVDAATSL

SEQ ID NO: 2958 - protein, 28 aa, Artificial Sequence
  Description of Artificial Sequence: Synthetic peptide
  C-terminus amidated
DDPKLYDKDLGSALWDWVVGWLDAAWSL

SEQ ID NO: 2959 - protein, 28 aa, Artificial Sequence
  Description of Artificial Sequence: Synthetic peptide
DDPKLYDKDLGSALWDWVVGWLDAAWSL

SEQ ID NO: 2960 - protein, 28 aa, Artificial Sequence
  Description of Artificial Sequence: Synthetic peptide
  C-terminus amidated
DDPKLYDKDLGSALWDWVVGWLDAATSL

SEQ ID NO: 2961 - protein, 28 aa, Artificial Sequence
  Description of Artificial Sequence: Synthetic peptide
DDPKLYDKDLGSALWDWVVGWLDAATSL

SEQ ID NO: 2962 - protein, 28 aa, Artificial Sequence
  Description of Artificial Sequence: Synthetic peptide
  C-terminus amidated
DDPKLYDKDLGSALWDWVVGWMDAAWSL

SEQ ID NO: 2963 - protein, 28 aa, Artificial Sequence
  Description of Artificial Sequence: Synthetic peptide
DDPKLYDKDLGSALWDWVVGWMDAAWSL

SEQ ID NO: 2964 - protein, 28 aa, Artificial Sequence
  Description of Artificial Sequence: Synthetic peptide
  C-terminus amidated
DDPKLYDKDLGSALWDWVVGWMDAATSL

SEQ ID NO: 2965 - protein, 28 aa, Artificial Sequence
  Description of Artificial Sequence: Synthetic peptide
DDPKLYDKDLGSALWDWVVGWMDAATSL

SEQ ID NO: 2966 - protein, 28 aa, Artificial Sequence
  Description of Artificial Sequence: Synthetic peptide
  C-terminus amidated
DDPKLYDKDLGSALWDWVVGQVDAAWSL

SEQ ID NO: 2967 - protein, 28 aa, Artificial Sequence
  Description of Artificial Sequence: Synthetic peptide
DDPKLYDKDLGSALWDWVVGQVDAAWSL

SEQ ID NO: 2968 - protein, 28 aa, Artificial Sequence
  Description of Artificial Sequence: Synthetic peptide
  C-terminus amidated
DDPKLYDKDLGSALWDWVVGQVDAATSL

SEQ ID NO: 2969 - protein, 28 aa, Artificial Sequence
  Description of Artificial Sequence: Synthetic peptide
DDPKLYDKDLGSALWDWVVGQVDAATSL

SEQ ID NO: 2970 - protein, 28 aa, Artificial Sequence
  Description of Artificial Sequence: Synthetic peptide
  C-terminus amidated
DDPKLYDKDLGSALWDWVVGQLDAAWSL

SEQ ID NO: 2971 - protein, 28 aa, Artificial Sequence
  Description of Artificial Sequence: Synthetic peptide
DDPKLYDKDLGSALWDWVVGQLDAAWSL

SEQ ID NO: 2972 - protein, 28 aa, Artificial Sequence
  Description of Artificial Sequence: Synthetic peptide
  C-terminus amidated
DDPKLYDKDLGSALWDWVVGQLDAATSL

SEQ ID NO: 2973 - protein, 28 aa, Artificial Sequence
  Description of Artificial Sequence: Synthetic peptide
DDPKLYDKDLGSALWDWVVGQLDAATSL

SEQ ID NO: 2974 - protein, 28 aa, Artificial Sequence
  Description of Artificial Sequence: Synthetic peptide
  C-terminus amidated
DDPKLYDKDLGSALWDWVVGQMDAAWSL

SEQ ID NO: 2975 - protein, 28 aa, Artificial Sequence
  Description of Artificial Sequence: Synthetic peptide
DDPKLYDKDLGSALWDWVVGQMDAAWSL

SEQ ID NO: 2976 - protein, 28 aa, Artificial Sequence
  Description of Artificial Sequence: Synthetic peptide
  C-terminus amidated
DDPKLYDKDLGSALWDWVVGQMDAATSL

SEQ ID NO: 2977 - protein, 28 aa, Artificial Sequence
  Description of Artificial Sequence: Synthetic peptide
DDPKLYDKDLGSALWDWVVGQMDAATSL

SEQ ID NO: 2978 - protein, 28 aa, Artificial Sequence
  Description of Artificial Sequence: Synthetic peptide
  C-terminus amidated
DDPKLYDKDLGSALWDTVVAWVDAAWSL

SEQ ID NO: 2979 - protein, 28 aa, Artificial Sequence
  Description of Artificial Sequence: Synthetic peptide
DDPKLYDKDLGSALWDTVVAWVDAAWSL

SEQ ID NO: 2980 - protein, 28 aa, Artificial Sequence
  Description of Artificial Sequence: Synthetic peptide
  C-terminus amidated
DDPKLYDKDLGSALWDTVVAWVDAATSL

SEQ ID NO: 2981 - protein, 28 aa, Artificial Sequence
  Description of Artificial Sequence: Synthetic peptide
DDPKLYDKDLGSALWDTVVAWVDAATSL

SEQ ID NO: 2982 - protein, 28 aa, Artificial Sequence
  Description of Artificial Sequence: Synthetic peptide
  C-terminus amidated
DDPKLYDKDLGSALWDTVVAWLDAAWSL

SEQ ID NO: 2983 - protein, 28 aa, Artificial Sequence
  Description of Artificial Sequence: Synthetic peptide
DDPKLYDKDLGSALWDTVVAWLDAAWSL

SEQ ID NO: 2984 - protein, 28 aa, Artificial Sequence
  Description of Artificial Sequence: Synthetic peptide
  C-terminus amidated
DDPKLYDKDLGSALWDTVVAWLDAATSL

SEQ ID NO: 2985 - protein, 28 aa, Artificial Sequence
  Description of Artificial Sequence: Synthetic peptide
DDPKLYDKDLGSALWDTVVAWLDAATSL

SEQ ID NO: 2986 - protein, 28 aa, Artificial Sequence
  Description of Artificial Sequence: Synthetic peptide
  C-terminus amidated
DDPKLYDKDLGSALWDTVVAWMDAAWSL

SEQ ID NO: 2987 - protein, 28 aa, Artificial Sequence
  Description of Artificial Sequence: Synthetic peptide
DDPKLYDKDLGSALWDTVVAWMDAAWSL

SEQ ID NO: 2988 - protein, 28 aa, Artificial Sequence
  Description of Artificial Sequence: Synthetic peptide
  C-terminus amidated
DDPKLYDKDLGSALWDTVVAWMDAATSL

SEQ ID NO: 2989 - protein, 28 aa, Artificial Sequence
  Description of Artificial Sequence: Synthetic peptide
DDPKLYDKDLGSALWDTVVAWMDAATSL

SEQ ID NO: 2990 - protein, 28 aa, Artificial Sequence
  Description of Artificial Sequence: Synthetic peptide
  C-terminus amidated
DDPKLYDKDLGSALWDTVVAQVDAAWSL

SEQ ID NO: 2991 - protein, 28 aa, Artificial Sequence
  Description of Artificial Sequence: Synthetic peptide
DDPKLYDKDLGSALWDTVVAQVDAAWSL

SEQ ID NO: 2992 - protein, 28 aa, Artificial Sequence
  Description of Artificial Sequence: Synthetic peptide
  C-terminus amidated
DDPKLYDKDLGSALWDTVVAQVDAATSL

SEQ ID NO: 2993 - protein, 28 aa, Artificial Sequence
  Description of Artificial Sequence: Synthetic peptide
DDPKLYDKDLGSALWDTVVAQVDAATSL

SEQ ID NO: 2994 - protein, 28 aa, Artificial Sequence
  Description of Artificial Sequence: Synthetic peptide
  C-terminus amidated
DDPKLYDKDLGSALWDTVVAQLDAAWSL

SEQ ID NO: 2995 - protein, 28 aa, Artificial Sequence
  Description of Artificial Sequence: Synthetic peptide
DDPKLYDKDLGSALWDTVVAQLDAAWSL

SEQ ID NO: 2996 - protein, 28 aa, Artificial Sequence
  Description of Artificial Sequence: Synthetic peptide
  C-terminus amidated
DDPKLYDKDLGSALWDTVVAQLDAATSL

SEQ ID NO: 2997 - protein, 28 aa, Artificial Sequence
  Description of Artificial Sequence: Synthetic peptide
DDPKLYDKDLGSALWDTVVAQLDAATSL

SEQ ID NO: 2998 - protein, 28 aa, Artificial Sequence
  Description of Artificial Sequence: Synthetic peptide
  C-terminus amidated
DDPKLYDKDLGSALWDTVVAQMDAAWSL

SEQ ID NO: 2999 - protein, 28 aa, Artificial Sequence
  Description of Artificial Sequence: Synthetic peptide
DDPKLYDKDLGSALWDTVVAQMDAAWSL

SEQ ID NO: 3000 - protein, 28 aa, Artificial Sequence
  Description of Artificial Sequence: Synthetic peptide
  C-terminus amidated
DDPKLYDKDLGSALWDTVVAQMDAATSL

SEQ ID NO: 3001 - protein, 28 aa, Artificial Sequence
  Description of Artificial Sequence: Synthetic peptide
DDPKLYDKDLGSALWDTVVAQMDAATSL

SEQ ID NO: 3002 - protein, 28 aa, Artificial Sequence
  Description of Artificial Sequence: Synthetic peptide
  C-terminus amidated
DDPKLYDKDLGSALWDTVVGWVDAAWSL

SEQ ID NO: 3003 - protein, 28 aa, Artificial Sequence
  Description of Artificial Sequence: Synthetic peptide
DDPKLYDKDLGSALWDTVVGWVDAAWSL

SEQ ID NO: 3004 - protein, 28 aa, Artificial Sequence
  Description of Artificial Sequence: Synthetic peptide
  C-terminus amidated
DDPKLYDKDLGSALWDTVVGWVDAATSL

SEQ ID NO: 3005 - protein, 28 aa, Artificial Sequence
  Description of Artificial Sequence: Synthetic peptide
DDPKLYDKDLGSALWDTVVGWVDAATSL

SEQ ID NO: 3006 - protein, 28 aa, Artificial Sequence
  Description of Artificial Sequence: Synthetic peptide
  C-terminus amidated
DDPKLYDKDLGSALWDTVVGWLDAAWSL

SEQ ID NO: 3007 - protein, 28 aa, Artificial Sequence
  Description of Artificial Sequence: Synthetic peptide
DDPKLYDKDLGSALWDTVVGWLDAAWSL

SEQ ID NO: 3008 - protein, 28 aa, Artificial Sequence
  Description of Artificial Sequence: Synthetic peptide
  C-terminus amidated
DDPKLYDKDLGSALWDTVVGWLDAATSL

SEQ ID NO: 3009 - protein, 28 aa, Artificial Sequence
  Description of Artificial Sequence: Synthetic peptide
DDPKLYDKDLGSALWDTVVGWLDAATSL

SEQ ID NO: 3010 - protein, 28 aa, Artificial Sequence
  Description of Artificial Sequence: Synthetic peptide
  C-terminus amidated
DDPKLYDKDLGSALWDTVVGWMDAAWSL

SEQ ID NO: 3011 - protein, 28 aa, Artificial Sequence
  Description of Artificial Sequence: Synthetic peptide
DDPKLYDKDLGSALWDTVVGWMDAAWSL

SEQ ID NO: 3012 - protein, 28 aa, Artificial Sequence
  Description of Artificial Sequence: Synthetic peptide
  C-terminus amidated
DDPKLYDKDLGSALWDTVVGWMDAATSL

SEQ ID NO: 3013 - protein, 28 aa, Artificial Sequence
  Description of Artificial Sequence: Synthetic peptide
DDPKLYDKDLGSALWDTVVGWMDAATSL

SEQ ID NO: 3014 - protein, 28 aa, Artificial Sequence
  Description of Artificial Sequence: Synthetic peptide
  C-terminus amidated
DDPKLYDKDLGSALWDTVVGQVDAAWSL

SEQ ID NO: 3015 - protein, 28 aa, Artificial Sequence
  Description of Artificial Sequence: Synthetic peptide
DDPKLYDKDLGSALWDTVVGQVDAAWSL

SEQ ID NO: 3016 - protein, 28 aa, Artificial Sequence
  Description of Artificial Sequence: Synthetic peptide
  C-terminus amidated
DDPKLYDKDLGSALWDTVVGQVDAATSL

SEQ ID NO: 3017 - protein, 28 aa, Artificial Sequence
  Description of Artificial Sequence: Synthetic peptide
DDPKLYDKDLGSALWDTVVGQVDAATSL

SEQ ID NO: 3018 - protein, 28 aa, Artificial Sequence
  Description of Artificial Sequence: Synthetic peptide
  C-terminus amidated
DDPKLYDKDLGSALWDTVVGQLDAAWSL

SEQ ID NO: 3019 - protein, 28 aa, Artificial Sequence
  Description of Artificial Sequence: Synthetic peptide
DDPKLYDKDLGSALWDTVVGQLDAAWSL

SEQ ID NO: 3020 - protein, 28 aa, Artificial Sequence
  Description of Artificial Sequence: Synthetic peptide
  C-terminus amidated
DDPKLYDKDLGSALWDTVVGQLDAATSL

SEQ ID NO: 3021 - protein, 28 aa, Artificial Sequence
  Description of Artificial Sequence: Synthetic peptide
DDPKLYDKDLGSALWDTVVGQLDAATSL

SEQ ID NO: 3022 - protein, 28 aa, Artificial Sequence
  Description of Artificial Sequence: Synthetic peptide
  C-terminus amidated
DDPKLYDKDLGSALWDTVVGQMDAAWSL

SEQ ID NO: 3023 - protein, 28 aa, Artificial Sequence
  Description of Artificial Sequence: Synthetic peptide
DDPKLYDKDLGSALWDTVVGQMDAAWSL

SEQ ID NO: 3024 - protein, 28 aa, Artificial Sequence
  Description of Artificial Sequence: Synthetic peptide
  C-terminus amidated
DDPKLYDKDLGSALWDTVVGQMDAATSL

SEQ ID NO: 3025 - protein, 28 aa, Artificial Sequence
  Description of Artificial Sequence: Synthetic peptide
DDPKLYDKDLGSALWDTVVGQMDAATSL

SEQ ID NO: 3026 - protein, 28 aa, Artificial Sequence
  Description of Artificial Sequence: Synthetic peptide
  C-terminus amidated
DDPKLYDKDLGSALTDWVVAWVDAAWSL

SEQ ID NO: 3027 - protein, 28 aa, Artificial Sequence
  Description of Artificial Sequence: Synthetic peptide
DDPKLYDKDLGSALTDWVVAWVDAAWSL

SEQ ID NO: 3028 - protein, 28 aa, Artificial Sequence
  Description of Artificial Sequence: Synthetic peptide
  C-terminus amidated
DDPKLYDKDLGSALTDWVVAWVDAATSL

SEQ ID NO: 3029 - protein, 28 aa, Artificial Sequence
  Description of Artificial Sequence: Synthetic peptide
DDPKLYDKDLGSALTDWVVAWVDAATSL

SEQ ID NO: 3030 - protein, 28 aa, Artificial Sequence
  Description of Artificial Sequence: Synthetic peptide
  C-terminus amidated
DDPKLYDKDLGSALTDWVVAWLDAAWSL

SEQ ID NO: 3031 - protein, 28 aa, Artificial Sequence
  Description of Artificial Sequence: Synthetic peptide
DDPKLYDKDLGSALTDWVVAWLDAAWSL

SEQ ID NO: 3032 - protein, 28 aa, Artificial Sequence
  Description of Artificial Sequence: Synthetic peptide
  C-terminus amidated
DDPKLYDKDLGSALTDWVVAWLDAATSL

SEQ ID NO: 3033 - protein, 28 aa, Artificial Sequence
  Description of Artificial Sequence: Synthetic peptide
DDPKLYDKDLGSALTDWVVAWLDAATSL

SEQ ID NO: 3034 - protein, 28 aa, Artificial Sequence
  Description of Artificial Sequence: Synthetic peptide
  C-terminus amidated
DDPKLYDKDLGSALTDWVVAWMDAAWSL

SEQ ID NO: 3035 - protein, 28 aa, Artificial Sequence
  Description of Artificial Sequence: Synthetic peptide
DDPKLYDKDLGSALTDWVVAWMDAAWSL

SEQ ID NO: 3036 - protein, 28 aa, Artificial Sequence
  Description of Artificial Sequence: Synthetic peptide
  C-terminus amidated
DDPKLYDKDLGSALTDWVVAWMDAATSL

SEQ ID NO: 3037 - protein, 28 aa, Artificial Sequence
  Description of Artificial Sequence: Synthetic peptide
DDPKLYDKDLGSALTDWVVAWMDAATSL

SEQ ID NO: 3038 - protein, 28 aa, Artificial Sequence
  Description of Artificial Sequence: Synthetic peptide
  C-terminus amidated
DDPKLYDKDLGSALTDWVVAQVDAAWSL

SEQ ID NO: 3039 - protein, 28 aa, Artificial Sequence
  Description of Artificial Sequence: Synthetic peptide
DDPKLYDKDLGSALTDWVVAQVDAAWSL

SEQ ID NO: 3040 - protein, 28 aa, Artificial Sequence
  Description of Artificial Sequence: Synthetic peptide
  C-terminus amidated
DDPKLYDKDLGSALTDWVVAQVDAATSL

SEQ ID NO: 3041 - protein, 28 aa, Artificial Sequence
  Description of Artificial Sequence: Synthetic peptide
DDPKLYDKDLGSALTDWVVAQVDAATSL

SEQ ID NO: 3042 - protein, 28 aa, Artificial Sequence
  Description of Artificial Sequence: Synthetic peptide
  C-terminus amidated
DDPKLYDKDLGSALTDWVVAQLDAAWSL

SEQ ID NO: 3043 - protein, 28 aa, Artificial Sequence
  Description of Artificial Sequence: Synthetic peptide
DDPKLYDKDLGSALTDWVVAQLDAAWSL

SEQ ID NO: 3044 - protein, 28 aa, Artificial Sequence
  Description of Artificial Sequence: Synthetic peptide
  C-terminus amidated
DDPKLYDKDLGSALTDWVVAQLDAATSL

SEQ ID NO: 3045 - protein, 28 aa, Artificial Sequence
  Description of Artificial Sequence: Synthetic peptide
DDPKLYDKDLGSALTDWVVAQLDAATSL

SEQ ID NO: 3046 - protein, 28 aa, Artificial Sequence
  Description of Artificial Sequence: Synthetic peptide
  C-terminus amidated
DDPKLYDKDLGSALTDWVVAQMDAAWSL

SEQ ID NO: 3047 - protein, 28 aa, Artificial Sequence
  Description of Artificial Sequence: Synthetic peptide
DDPKLYDKDLGSALTDWVVAQMDAAWSL

SEQ ID NO: 3048 - protein, 28 aa, Artificial Sequence
  Description of Artificial Sequence: Synthetic peptide
  C-terminus amidated
DDPKLYDKDLGSALTDWVVAQMDAATSL

SEQ ID NO: 3049 - protein, 28 aa, Artificial Sequence
  Description of Artificial Sequence: Synthetic peptide
DDPKLYDKDLGSALTDWVVAQMDAATSL

SEQ ID NO: 3050 - protein, 28 aa, Artificial Sequence
  Description of Artificial Sequence: Synthetic peptide
  C-terminus amidated
DDPKLYDKDLGSALTDWVVGWVDAAWSL

SEQ ID NO: 3051 - protein, 28 aa, Artificial Sequence
  Description of Artificial Sequence: Synthetic peptide
DDPKLYDKDLGSALTDWVVGWVDAAWSL

SEQ ID NO: 3052 - protein, 28 aa, Artificial Sequence
  Description of Artificial Sequence: Synthetic peptide
  C-terminus amidated
DDPKLYDKDLGSALTDWVVGWVDAATSL

SEQ ID NO: 3053 - protein, 28 aa, Artificial Sequence
  Description of Artificial Sequence: Synthetic peptide
DDPKLYDKDLGSALTDWVVGWVDAATSL

SEQ ID NO: 3054 - protein, 28 aa, Artificial Sequence
  Description of Artificial Sequence: Synthetic peptide
  C-terminus amidated
DDPKLYDKDLGSALTDWVVGWLDAAWSL

SEQ ID NO: 3055 - protein, 28 aa, Artificial Sequence
  Description of Artificial Sequence: Synthetic peptide
DDPKLYDKDLGSALTDWVVGWLDAAWSL

SEQ ID NO: 3056 - protein, 28 aa, Artificial Sequence
  Description of Artificial Sequence: Synthetic peptide
  C-terminus amidated
DDPKLYDKDLGSALTDWVVGWLDAATSL

SEQ ID NO: 3057 - protein, 28 aa, Artificial Sequence
  Description of Artificial Sequence: Synthetic peptide
DDPKLYDKDLGSALTDWVVGWLDAATSL

SEQ ID NO: 3058 - protein, 28 aa, Artificial Sequence
  Description of Artificial Sequence: Synthetic peptide
  C-terminus amidated
DDPKLYDKDLGSALTDWVVGWMDAAWSL

SEQ ID NO: 3059 - protein, 28 aa, Artificial Sequence
  Description of Artificial Sequence: Synthetic peptide
DDPKLYDKDLGSALTDWVVGWMDAAWSL

SEQ ID NO: 3060 - protein, 28 aa, Artificial Sequence
  Description of Artificial Sequence: Synthetic peptide
  C-terminus amidated
DDPKLYDKDLGSALTDWVVGWMDAATSL

SEQ ID NO: 3061 - protein, 28 aa, Artificial Sequence
  Description of Artificial Sequence: Synthetic peptide
DDPKLYDKDLGSALTDWVVGWMDAATSL

SEQ ID NO: 3062 - protein, 28 aa, Artificial Sequence
  Description of Artificial Sequence: Synthetic peptide
  C-terminus amidated
DDPKLYDKDLGSALTDWVVGQVDAAWSL

SEQ ID NO: 3063 - protein, 28 aa, Artificial Sequence
  Description of Artificial Sequence: Synthetic peptide
DDPKLYDKDLGSALTDWVVGQVDAAWSL

SEQ ID NO: 3064 - protein, 28 aa, Artificial Sequence
  Description of Artificial Sequence: Synthetic peptide
  C-terminus amidated
DDPKLYDKDLGSALTDWVVGQVDAATSL

SEQ ID NO: 3065 - protein, 28 aa, Artificial Sequence
  Description of Artificial Sequence: Synthetic peptide
DDPKLYDKDLGSALTDWVVGQVDAATSL

SEQ ID NO: 3066 - protein, 28 aa, Artificial Sequence
  Description of Artificial Sequence: Synthetic peptide
  C-terminus amidated
DDPKLYDKDLGSALTDWVVGQLDAAWSL

SEQ ID NO: 3067 - protein, 28 aa, Artificial Sequence
  Description of Artificial Sequence: Synthetic peptide
DDPKLYDKDLGSALTDWVVGQLDAAWSL

SEQ ID NO: 3068 - protein, 28 aa, Artificial Sequence
  Description of Artificial Sequence: Synthetic peptide
  C-terminus amidated
DDPKLYDKDLGSALTDWVVGQLDAATSL

SEQ ID NO: 3069 - protein, 28 aa, Artificial Sequence
  Description of Artificial Sequence: Synthetic peptide
DDPKLYDKDLGSALTDWVVGQLDAATSL

SEQ ID NO: 3070 - protein, 28 aa, Artificial Sequence
  Description of Artificial Sequence: Synthetic peptide
  C-terminus amidated
DDPKLYDKDLGSALTDWVVGQMDAAWSL

SEQ ID NO: 3071 - protein, 28 aa, Artificial Sequence
  Description of Artificial Sequence: Synthetic peptide
DDPKLYDKDLGSALTDWVVGQMDAAWSL

SEQ ID NO: 3072 - protein, 28 aa, Artificial Sequence
  Description of Artificial Sequence: Synthetic peptide
  C-terminus amidated
DDPKLYDKDLGSALTDWVVGQMDAATSL

SEQ ID NO: 3073 - protein, 28 aa, Artificial Sequence
  Description of Artificial Sequence: Synthetic peptide
DDPKLYDKDLGSALTDWVVGQMDAATSL

SEQ ID NO: 3074 - protein, 28 aa, Artificial Sequence
  Description of Artificial Sequence: Synthetic peptide
  C-terminus amidated
DDPKLYDKDLGSALTDTVVAWVDAAWSL

SEQ ID NO: 3075 - protein, 28 aa, Artificial Sequence
  Description of Artificial Sequence: Synthetic peptide
DDPKLYDKDLGSALTDTVVAWVDAAWSL

SEQ ID NO: 3076 - protein, 28 aa, Artificial Sequence
  Description of Artificial Sequence: Synthetic peptide
  C-terminus amidated
DDPKLYDKDLGSALTDTVVAWVDAATSL

SEQ ID NO: 3077 - protein, 28 aa, Artificial Sequence
  Description of Artificial Sequence: Synthetic peptide
DDPKLYDKDLGSALTDTVVAWVDAATSL

SEQ ID NO: 3078 - protein, 28 aa, Artificial Sequence
  Description of Artificial Sequence: Synthetic peptide
  C-terminus amidated
DDPKLYDKDLGSALTDTVVAWLDAAWSL

SEQ ID NO: 3079 - protein, 28 aa, Artificial Sequence
  Description of Artificial Sequence: Synthetic peptide
DDPKLYDKDLGSALTDTVVAWLDAAWSL

SEQ ID NO: 3080 - protein, 28 aa, Artificial Sequence
  Description of Artificial Sequence: Synthetic peptide
  C-terminus amidated
DDPKLYDKDLGSALTDTVVAWLDAATSL

SEQ ID NO: 3081 - protein, 28 aa, Artificial Sequence
  Description of Artificial Sequence: Synthetic peptide
DDPKLYDKDLGSALTDTVVAWLDAATSL

SEQ ID NO: 3082 - protein, 28 aa, Artificial Sequence
  Description of Artificial Sequence: Synthetic peptide
  C-terminus amidated
DDPKLYDKDLGSALTDTVVAWMDAAWSL

SEQ ID NO: 3083 - protein, 28 aa, Artificial Sequence
  Description of Artificial Sequence: Synthetic peptide
DDPKLYDKDLGSALTDTVVAWMDAAWSL

SEQ ID NO: 3084 - protein, 28 aa, Artificial Sequence
  Description of Artificial Sequence: Synthetic peptide
  C-terminus amidated
DDPKLYDKDLGSALTDTVVAWMDAATSL

SEQ ID NO: 3085 - protein, 28 aa, Artificial Sequence
  Description of Artificial Sequence: Synthetic peptide
DDPKLYDKDLGSALTDTVVAWMDAATSL

SEQ ID NO: 3086 - protein, 28 aa, Artificial Sequence
  Description of Artificial Sequence: Synthetic peptide
  C-terminus amidated
DDPKLYDKDLGSALTDTVVAQVDAAWSL

SEQ ID NO: 3087 - protein, 28 aa, Artificial Sequence
  Description of Artificial Sequence: Synthetic peptide
DDPKLYDKDLGSALTDTVVAQVDAAWSL

SEQ ID NO: 3088 - protein, 28 aa, Artificial Sequence
  Description of Artificial Sequence: Synthetic peptide
  C-terminus amidated
DDPKLYDKDLGSALTDTVVAQVDAATSL

SEQ ID NO: 3089 - protein, 28 aa, Artificial Sequence
  Description of Artificial Sequence: Synthetic peptide
DDPKLYDKDLGSALTDTVVAQVDAATSL

SEQ ID NO: 3090 - protein, 28 aa, Artificial Sequence
  Description of Artificial Sequence: Synthetic peptide
  C-terminus amidated
DDPKLYDKDLGSALTDTVVAQLDAAWSL

SEQ ID NO: 3091 - protein, 28 aa, Artificial Sequence
  Description of Artificial Sequence: Synthetic peptide
DDPKLYDKDLGSALTDTVVAQLDAAWSL

SEQ ID NO: 3092 - protein, 28 aa, Artificial Sequence
  Description of Artificial Sequence: Synthetic peptide
  C-terminus amidated
DDPKLYDKDLGSALTDTVVAQLDAATSL

SEQ ID NO: 3093 - protein, 28 aa, Artificial Sequence
  Description of Artificial Sequence: Synthetic peptide
DDPKLYDKDLGSALTDTVVAQLDAATSL

SEQ ID NO: 3094 - protein, 28 aa, Artificial Sequence
  Description of Artificial Sequence: Synthetic peptide
  C-terminus amidated
DDPKLYDKDLGSALTDTVVAQMDAAWSL

SEQ ID NO: 3095 - protein, 28 aa, Artificial Sequence
  Description of Artificial Sequence: Synthetic peptide
DDPKLYDKDLGSALTDTVVAQMDAAWSL

SEQ ID NO: 3096 - protein, 28 aa, Artificial Sequence
  Description of Artificial Sequence: Synthetic peptide
  C-terminus amidated
DDPKLYDKDLGSALTDTVVAQMDAATSL

SEQ ID NO: 3097 - protein, 28 aa, Artificial Sequence
  Description of Artificial Sequence: Synthetic peptide
DDPKLYDKDLGSALTDTVVAQMDAATSL

SEQ ID NO: 3098 - protein, 28 aa, Artificial Sequence
  Description of Artificial Sequence: Synthetic peptide
  C-terminus amidated
DDPKLYDKDLGSALTDTVVGWVDAAWSL

SEQ ID NO: 3099 - protein, 28 aa, Artificial Sequence
  Description of Artificial Sequence: Synthetic peptide
DDPKLYDKDLGSALTDTVVGWVDAAWSL

SEQ ID NO: 3100 - protein, 28 aa, Artificial Sequence
  Description of Artificial Sequence: Synthetic peptide
  C-terminus amidated
DDPKLYDKDLGSALTDTVVGWVDAATSL

SEQ ID NO: 3101 - protein, 28 aa, Artificial Sequence
  Description of Artificial Sequence: Synthetic peptide
DDPKLYDKDLGSALTDTVVGWVDAATSL

SEQ ID NO: 3102 - protein, 28 aa, Artificial Sequence
  Description of Artificial Sequence: Synthetic peptide
  C-terminus amidated
DDPKLYDKDLGSALTDTVVGWLDAAWSL

SEQ ID NO: 3103 - protein, 28 aa, Artificial Sequence
  Description of Artificial Sequence: Synthetic peptide
DDPKLYDKDLGSALTDTVVGWLDAAWSL

SEQ ID NO: 3104 - protein, 28 aa, Artificial Sequence
  Description of Artificial Sequence: Synthetic peptide
  C-terminus amidated
DDPKLYDKDLGSALTDTVVGWLDAATSL

SEQ ID NO: 3105 - protein, 28 aa, Artificial Sequence
  Description of Artificial Sequence: Synthetic peptide
DDPKLYDKDLGSALTDTVVGWLDAATSL

SEQ ID NO: 3106 - protein, 28 aa, Artificial Sequence
  Description of Artificial Sequence: Synthetic peptide
  C-terminus amidated
DDPKLYDKDLGSALTDTVVGWMDAAWSL

SEQ ID NO: 3107 - protein, 28 aa, Artificial Sequence
  Description of Artificial Sequence: Synthetic peptide
DDPKLYDKDLGSALTDTVVGWMDAAWSL

SEQ ID NO: 3108 - protein, 28 aa, Artificial Sequence
  Description of Artificial Sequence: Synthetic peptide
  C-terminus amidated
DDPKLYDKDLGSALTDTVVGWMDAATSL

SEQ ID NO: 3109 - protein, 28 aa, Artificial Sequence
  Description of Artificial Sequence: Synthetic peptide
DDPKLYDKDLGSALTDTVVGWMDAATSL

SEQ ID NO: 3110 - protein, 28 aa, Artificial Sequence
  Description of Artificial Sequence: Synthetic peptide
  C-terminus amidated
DDPKLYDKDLGSALTDTVVGQVDAAWSL

SEQ ID NO: 3111 - protein, 28 aa, Artificial Sequence
  Description of Artificial Sequence: Synthetic peptide
DDPKLYDKDLGSALTDTVVGQVDAAWSL

SEQ ID NO: 3112 - protein, 28 aa, Artificial Sequence
  Description of Artificial Sequence: Synthetic peptide
  C-terminus amidated
DDPKLYDKDLGSALTDTVVGQVDAATSL

SEQ ID NO: 3113 - protein, 28 aa, Artificial Sequence
  Description of Artificial Sequence: Synthetic peptide
DDPKLYDKDLGSALTDTVVGQVDAATSL

SEQ ID NO: 3114 - protein, 28 aa, Artificial Sequence
  Description of Artificial Sequence: Synthetic peptide
  C-terminus amidated
DDPKLYDKDLGSALTDTVVGQLDAAWSL

SEQ ID NO: 3115 - protein, 28 aa, Artificial Sequence
  Description of Artificial Sequence: Synthetic peptide
DDPKLYDKDLGSALTDTVVGQLDAAWSL

SEQ ID NO: 3116 - protein, 28 aa, Artificial Sequence
  Description of Artificial Sequence: Synthetic peptide
  C-terminus amidated
DDPKLYDKDLGSALTDTVVGQLDAATSL

SEQ ID NO: 3117 - protein, 28 aa, Artificial Sequence
  Description of Artificial Sequence: Synthetic peptide
DDPKLYDKDLGSALTDTVVGQLDAATSL

SEQ ID NO: 3118 - protein, 28 aa, Artificial Sequence
  Description of Artificial Sequence: Synthetic peptide
  C-terminus amidated
DDPKLYDKDLGSALTDTVVGQMDAAWSL

SEQ ID NO: 3119 - protein, 28 aa, Artificial Sequence
  Description of Artificial Sequence: Synthetic peptide
DDPKLYDKDLGSALTDTVVGQMDAAWSL

SEQ ID NO: 3120 - protein, 28 aa, Artificial Sequence
  Description of Artificial Sequence: Synthetic peptide
  C-terminus amidated
DDPKLYDKDLGSALTDTVVGQMDAATSL

SEQ ID NO: 3121 - protein, 28 aa, Artificial Sequence
  Description of Artificial Sequence: Synthetic peptide
DDPKLYDKDLGSALTDTVVGQMDAATSL

SEQ ID NO: 3122 - protein, 28 aa, Artificial Sequence
  Description of Artificial Sequence: Synthetic peptide
  C-terminus amidated
DDPKLYDKDLGSALGDWVVAWVDAAWSL

SEQ ID NO: 3123 - protein, 28 aa, Artificial Sequence
  Description of Artificial Sequence: Synthetic peptide
DDPKLYDKDLGSALGDWVVAWVDAAWSL

SEQ ID NO: 3124 - protein, 28 aa, Artificial Sequence
  Description of Artificial Sequence: Synthetic peptide
  C-terminus amidated
DDPKLYDKDLGSALGDWVVAWVDAATSL

SEQ ID NO: 3125 - protein, 28 aa, Artificial Sequence
  Description of Artificial Sequence: Synthetic peptide
DDPKLYDKDLGSALGDWVVAWVDAATSL

SEQ ID NO: 3126 - protein, 28 aa, Artificial Sequence
  Description of Artificial Sequence: Synthetic peptide
  C-terminus amidated
DDPKLYDKDLGSALGDWVVAWLDAAWSL

SEQ ID NO: 3127 - protein, 28 aa, Artificial Sequence
  Description of Artificial Sequence: Synthetic peptide
DDPKLYDKDLGSALGDWVVAWLDAAWSL

SEQ ID NO: 3128 - protein, 28 aa, Artificial Sequence
  Description of Artificial Sequence: Synthetic peptide
  C-terminus amidated
DDPKLYDKDLGSALGDWVVAWLDAATSL

SEQ ID NO: 3129 - protein, 28 aa, Artificial Sequence
  Description of Artificial Sequence: Synthetic peptide
DDPKLYDKDLGSALGDWVVAWLDAATSL

SEQ ID NO: 3130 - protein, 28 aa, Artificial Sequence
  Description of Artificial Sequence: Synthetic peptide
  C-terminus amidated
DDPKLYDKDLGSALGDWVVAWMDAAWSL

SEQ ID NO: 3131 - protein, 28 aa, Artificial Sequence
  Description of Artificial Sequence: Synthetic peptide
DDPKLYDKDLGSALGDWVVAWMDAAWSL

SEQ ID NO: 3132 - protein, 28 aa, Artificial Sequence
  Description of Artificial Sequence: Synthetic peptide
  C-terminus amidated
DDPKLYDKDLGSALGDWVVAWMDAATSL

SEQ ID NO: 3133 - protein, 28 aa, Artificial Sequence
  Description of Artificial Sequence: Synthetic peptide
DDPKLYDKDLGSALGDWVVAWMDAATSL

SEQ ID NO: 3134 - protein, 28 aa, Artificial Sequence
  Description of Artificial Sequence: Synthetic peptide
  C-terminus amidated
DDPKLYDKDLGSALGDWVVAQVDAAWSL

SEQ ID NO: 3135 - protein, 28 aa, Artificial Sequence
  Description of Artificial Sequence: Synthetic peptide
DDPKLYDKDLGSALGDWVVAQVDAAWSL

SEQ ID NO: 3136 - protein, 28 aa, Artificial Sequence
  Description of Artificial Sequence: Synthetic peptide
  C-terminus amidated
DDPKLYDKDLGSALGDWVVAQVDAATSL

SEQ ID NO: 3137 - protein, 28 aa, Artificial Sequence
  Description of Artificial Sequence: Synthetic peptide
DDPKLYDKDLGSALGDWVVAQVDAATSL

SEQ ID NO: 3138 - protein, 28 aa, Artificial Sequence
  Description of Artificial Sequence: Synthetic peptide
  C-terminus amidated
DDPKLYDKDLGSALGDWVVAQLDAAWSL

SEQ ID NO: 3139 - protein, 28 aa, Artificial Sequence
  Description of Artificial Sequence: Synthetic peptide
DDPKLYDKDLGSALGDWVVAQLDAAWSL

SEQ ID NO: 3140 - protein, 28 aa, Artificial Sequence
  Description of Artificial Sequence: Synthetic peptide
  C-terminus amidated
DDPKLYDKDLGSALGDWVVAQLDAATSL

SEQ ID NO: 3141 - protein, 28 aa, Artificial Sequence
  Description of Artificial Sequence: Synthetic peptide
DDPKLYDKDLGSALGDWVVAQLDAATSL

SEQ ID NO: 3142 - protein, 28 aa, Artificial Sequence
  Description of Artificial Sequence: Synthetic peptide
  C-terminus amidated
DDPKLYDKDLGSALGDWVVAQMDAAWSL

SEQ ID NO: 3143 - protein, 28 aa, Artificial Sequence
  Description of Artificial Sequence: Synthetic peptide
DDPKLYDKDLGSALGDWVVAQMDAAWSL

SEQ ID NO: 3144 - protein, 28 aa, Artificial Sequence
  Description of Artificial Sequence: Synthetic peptide
  C-terminus amidated
DDPKLYDKDLGSALGDWVVAQMDAATSL

SEQ ID NO: 3145 - protein, 28 aa, Artificial Sequence
  Description of Artificial Sequence: Synthetic peptide
DDPKLYDKDLGSALGDWVVAQMDAATSL

SEQ ID NO: 3146 - protein, 28 aa, Artificial Sequence
  Description of Artificial Sequence: Synthetic peptide
  C-terminus amidated
DDPKLYDKDLGSALGDWVVGWVDAAWSL

SEQ ID NO: 3147 - protein, 28 aa, Artificial Sequence
  Description of Artificial Sequence: Synthetic peptide
DDPKLYDKDLGSALGDWVVGWVDAAWSL

SEQ ID NO: 3148 - protein, 28 aa, Artificial Sequence
  Description of Artificial Sequence: Synthetic peptide
  C-terminus amidated
DDPKLYDKDLGSALGDWVVGWVDAATSL

SEQ ID NO: 3149 - protein, 28 aa, Artificial Sequence
  Description of Artificial Sequence: Synthetic peptide
DDPKLYDKDLGSALGDWVVGWVDAATSL

SEQ ID NO: 3150 - protein, 28 aa, Artificial Sequence
  Description of Artificial Sequence: Synthetic peptide
  C-terminus amidated
DDPKLYDKDLGSALGDWVVGWLDAAWSL

SEQ ID NO: 3151 - protein, 28 aa, Artificial Sequence
  Description of Artificial Sequence: Synthetic peptide
DDPKLYDKDLGSALGDWVVGWLDAAWSL

SEQ ID NO: 3152 - protein, 28 aa, Artificial Sequence
  Description of Artificial Sequence: Synthetic peptide
  C-terminus amidated
DDPKLYDKDLGSALGDWVVGWLDAATSL

SEQ ID NO: 3153 - protein, 28 aa, Artificial Sequence
  Description of Artificial Sequence: Synthetic peptide
DDPKLYDKDLGSALGDWVVGWLDAATSL

SEQ ID NO: 3154 - protein, 28 aa, Artificial Sequence
  Description of Artificial Sequence: Synthetic peptide
  C-terminus amidated
DDPKLYDKDLGSALGDWVVGWMDAAWSL

SEQ ID NO: 3155 - protein, 28 aa, Artificial Sequence
  Description of Artificial Sequence: Synthetic peptide
DDPKLYDKDLGSALGDWVVGWMDAAWSL

SEQ ID NO: 3156 - protein, 28 aa, Artificial Sequence
  Description of Artificial Sequence: Synthetic peptide
  C-terminus amidated
DDPKLYDKDLGSALGDWVVGWMDAATSL

SEQ ID NO: 3157 - protein, 28 aa, Artificial Sequence
  Description of Artificial Sequence: Synthetic peptide
DDPKLYDKDLGSALGDWVVGWMDAATSL

SEQ ID NO: 3158 - protein, 28 aa, Artificial Sequence
  Description of Artificial Sequence: Synthetic peptide
  C-terminus amidated
DDPKLYDKDLGSALGDWVVGQVDAAWSL

SEQ ID NO: 3159 - protein, 28 aa, Artificial Sequence
  Description of Artificial Sequence: Synthetic peptide
DDPKLYDKDLGSALGDWVVGQVDAAWSL

SEQ ID NO: 3160 - protein, 28 aa, Artificial Sequence
  Description of Artificial Sequence: Synthetic peptide
  C-terminus amidated
DDPKLYDKDLGSALGDWVVGQVDAATSL

SEQ ID NO: 3161 - protein, 28 aa, Artificial Sequence
  Description of Artificial Sequence: Synthetic peptide
DDPKLYDKDLGSALGDWVVGQVDAATSL

SEQ ID NO: 3162 - protein, 28 aa, Artificial Sequence
  Description of Artificial Sequence: Synthetic peptide
  C-terminus amidated
DDPKLYDKDLGSALGDWVVGQLDAAWSL

SEQ ID NO: 3163 - protein, 28 aa, Artificial Sequence
  Description of Artificial Sequence: Synthetic peptide
DDPKLYDKDLGSALGDWVVGQLDAAWSL

SEQ ID NO: 3164 - protein, 28 aa, Artificial Sequence
  Description of Artificial Sequence: Synthetic peptide
  C-terminus amidated
DDPKLYDKDLGSALGDWVVGQLDAATSL

SEQ ID NO: 3165 - protein, 28 aa, Artificial Sequence
  Description of Artificial Sequence: Synthetic peptide
DDPKLYDKDLGSALGDWVVGQLDAATSL

SEQ ID NO: 3166 - protein, 28 aa, Artificial Sequence
  Description of Artificial Sequence: Synthetic peptide
  C-terminus amidated
DDPKLYDKDLGSALGDWVVGQMDAAWSL

SEQ ID NO: 3167 - protein, 28 aa, Artificial Sequence
  Description of Artificial Sequence: Synthetic peptide
DDPKLYDKDLGSALGDWVVGQMDAAWSL

SEQ ID NO: 3168 - protein, 28 aa, Artificial Sequence
  Description of Artificial Sequence: Synthetic peptide
  C-terminus amidated
DDPKLYDKDLGSALGDWVVGQMDAATSL

SEQ ID NO: 3169 - protein, 28 aa, Artificial Sequence
  Description of Artificial Sequence: Synthetic peptide
DDPKLYDKDLGSALGDWVVGQMDAATSL

SEQ ID NO: 3170 - protein, 28 aa, Artificial Sequence
  Description of Artificial Sequence: Synthetic peptide
  C-terminus amidated
DDPKLYDKDLGSALGDTVVAWVDAAWSL

SEQ ID NO: 3171 - protein, 28 aa, Artificial Sequence
  Description of Artificial Sequence: Synthetic peptide
DDPKLYDKDLGSALGDTVVAWVDAAWSL

SEQ ID NO: 3172 - protein, 28 aa, Artificial Sequence
  Description of Artificial Sequence: Synthetic peptide
  C-terminus amidated
DDPKLYDKDLGSALGDTVVAWVDAATSL

SEQ ID NO: 3173 - protein, 28 aa, Artificial Sequence
  Description of Artificial Sequence: Synthetic peptide
DDPKLYDKDLGSALGDTVVAWVDAATSL

SEQ ID NO: 3174 - protein, 28 aa, Artificial Sequence
  Description of Artificial Sequence: Synthetic peptide
  C-terminus amidated
DDPKLYDKDLGSALGDTVVAWLDAAWSL

SEQ ID NO: 3175 - protein, 28 aa, Artificial Sequence
  Description of Artificial Sequence: Synthetic peptide
DDPKLYDKDLGSALGDTVVAWLDAAWSL

SEQ ID NO: 3176 - protein, 28 aa, Artificial Sequence
  Description of Artificial Sequence: Synthetic peptide
  C-terminus amidated
DDPKLYDKDLGSALGDTVVAWLDAATSL

SEQ ID NO: 3177 - protein, 28 aa, Artificial Sequence
  Description of Artificial Sequence: Synthetic peptide
DDPKLYDKDLGSALGDTVVAWLDAATSL

SEQ ID NO: 3178 - protein, 28 aa, Artificial Sequence
  Description of Artificial Sequence: Synthetic peptide
  C-terminus amidated
DDPKLYDKDLGSALGDTVVAWMDAAWSL

SEQ ID NO: 3179 - protein, 28 aa, Artificial Sequence
  Description of Artificial Sequence: Synthetic peptide
DDPKLYDKDLGSALGDTVVAWMDAAWSL

SEQ ID NO: 3180 - protein, 28 aa, Artificial Sequence
  Description of Artificial Sequence: Synthetic peptide
  C-terminus amidated
DDPKLYDKDLGSALGDTVVAWMDAATSL

SEQ ID NO: 3181 - protein, 28 aa, Artificial Sequence
  Description of Artificial Sequence: Synthetic peptide
DDPKLYDKDLGSALGDTVVAWMDAATSL

SEQ ID NO: 3182 - protein, 28 aa, Artificial Sequence
  Description of Artificial Sequence: Synthetic peptide
  C-terminus amidated
DDPKLYDKDLGSALGDTVVAQVDAAWSL

SEQ ID NO: 3183 - protein, 28 aa, Artificial Sequence
  Description of Artificial Sequence: Synthetic peptide
DDPKLYDKDLGSALGDTVVAQVDAAWSL

SEQ ID NO: 3184 - protein, 28 aa, Artificial Sequence
  Description of Artificial Sequence: Synthetic peptide
  C-terminus amidated
DDPKLYDKDLGSALGDTVVAQVDAATSL

SEQ ID NO: 3185 - protein, 28 aa, Artificial Sequence
  Description of Artificial Sequence: Synthetic peptide
DDPKLYDKDLGSALGDTVVAQVDAATSL

SEQ ID NO: 3186 - protein, 28 aa, Artificial Sequence
  Description of Artificial Sequence: Synthetic peptide
  C-terminus amidated
DDPKLYDKDLGSALGDTVVAQLDAAWSL

SEQ ID NO: 3187 - protein, 28 aa, Artificial Sequence
  Description of Artificial Sequence: Synthetic peptide
DDPKLYDKDLGSALGDTVVAQLDAAWSL

SEQ ID NO: 3188 - protein, 28 aa, Artificial Sequence
  Description of Artificial Sequence: Synthetic peptide
  C-terminus amidated
DDPKLYDKDLGSALGDTVVAQLDAATSL

SEQ ID NO: 3189 - protein, 28 aa, Artificial Sequence
  Description of Artificial Sequence: Synthetic peptide
DDPKLYDKDLGSALGDTVVAQLDAATSL

SEQ ID NO: 3190 - protein, 28 aa, Artificial Sequence
  Description of Artificial Sequence: Synthetic peptide
  C-terminus amidated
DDPKLYDKDLGSALGDTVVAQMDAAWSL

SEQ ID NO: 3191 - protein, 28 aa, Artificial Sequence
  Description of Artificial Sequence: Synthetic peptide
DDPKLYDKDLGSALGDTVVAQMDAAWSL

SEQ ID NO: 3192 - protein, 28 aa, Artificial Sequence
  Description of Artificial Sequence: Synthetic peptide
  C-terminus amidated
DDPKLYDKDLGSALGDTVVAQMDAATSL

SEQ ID NO: 3193 - protein, 28 aa, Artificial Sequence
  Description of Artificial Sequence: Synthetic peptide
DDPKLYDKDLGSALGDTVVAQMDAATSL

SEQ ID NO: 3194 - protein, 28 aa, Artificial Sequence
  Description of Artificial Sequence: Synthetic peptide
  C-terminus amidated
DDPKLYDKDLGSALGDTVVGWVDAAWSL

SEQ ID NO: 3195 - protein, 28 aa, Artificial Sequence
  Description of Artificial Sequence: Synthetic peptide
DDPKLYDKDLGSALGDTVVGWVDAAWSL

SEQ ID NO: 3196 - protein, 28 aa, Artificial Sequence
  Description of Artificial Sequence: Synthetic peptide
  C-terminus amidated
DDPKLYDKDLGSALGDTVVGWVDAATSL

SEQ ID NO: 3197 - protein, 28 aa, Artificial Sequence
  Description of Artificial Sequence: Synthetic peptide
DDPKLYDKDLGSALGDTVVGWVDAATSL

SEQ ID NO: 3198 - protein, 28 aa, Artificial Sequence
  Description of Artificial Sequence: Synthetic peptide
  C-terminus amidated
DDPKLYDKDLGSALGDTVVGWLDAAWSL

SEQ ID NO: 3199 - protein, 28 aa, Artificial Sequence
  Description of Artificial Sequence: Synthetic peptide
DDPKLYDKDLGSALGDTVVGWLDAAWSL

SEQ ID NO: 3200 - protein, 28 aa, Artificial Sequence
  Description of Artificial Sequence: Synthetic peptide
  C-terminus amidated
DDPKLYDKDLGSALGDTVVGWLDAATSL

SEQ ID NO: 3201 - protein, 28 aa, Artificial Sequence
  Description of Artificial Sequence: Synthetic peptide
DDPKLYDKDLGSALGDTVVGWLDAATSL

SEQ ID NO: 3202 - protein, 28 aa, Artificial Sequence
  Description of Artificial Sequence: Synthetic peptide
  C-terminus amidated
DDPKLYDKDLGSALGDTVVGWMDAAWSL

SEQ ID NO: 3203 - protein, 28 aa, Artificial Sequence
  Description of Artificial Sequence: Synthetic peptide
DDPKLYDKDLGSALGDTVVGWMDAAWSL

SEQ ID NO: 3204 - protein, 28 aa, Artificial Sequence
  Description of Artificial Sequence: Synthetic peptide
  C-terminus amidated
DDPKLYDKDLGSALGDTVVGWMDAATSL

SEQ ID NO: 3205 - protein, 28 aa, Artificial Sequence
  Description of Artificial Sequence: Synthetic peptide
DDPKLYDKDLGSALGDTVVGWMDAATSL

SEQ ID NO: 3206 - protein, 28 aa, Artificial Sequence
  Description of Artificial Sequence: Synthetic peptide
  C-terminus amidated
DDPKLYDKDLGSALGDTVVGQVDAAWSL

SEQ ID NO: 3207 - protein, 28 aa, Artificial Sequence
  Description of Artificial Sequence: Synthetic peptide
DDPKLYDKDLGSALGDTVVGQVDAAWSL

SEQ ID NO: 3208 - protein, 28 aa, Artificial Sequence
  Description of Artificial Sequence: Synthetic peptide
  C-terminus amidated
DDPKLYDKDLGSALGDTVVGQVDAATSL

SEQ ID NO: 3209 - protein, 28 aa, Artificial Sequence
  Description of Artificial Sequence: Synthetic peptide
DDPKLYDKDLGSALGDTVVGQVDAATSL

SEQ ID NO: 3210 - protein, 28 aa, Artificial Sequence
  Description of Artificial Sequence: Synthetic peptide
  C-terminus amidated
DDPKLYDKDLGSALGDTVVGQLDAAWSL

SEQ ID NO: 3211 - protein, 28 aa, Artificial Sequence
  Description of Artificial Sequence: Synthetic peptide
DDPKLYDKDLGSALGDTVVGQLDAAWSL

SEQ ID NO: 3212 - protein, 28 aa, Artificial Sequence
  Description of Artificial Sequence: Synthetic peptide
  C-terminus amidated
DDPKLYDKDLGSALGDTVVGQLDAATSL

SEQ ID NO: 3213 - protein, 28 aa, Artificial Sequence
  Description of Artificial Sequence: Synthetic peptide
DDPKLYDKDLGSALGDTVVGQLDAATSL

SEQ ID NO: 3214 - protein, 28 aa, Artificial Sequence
  Description of Artificial Sequence: Synthetic peptide
  C-terminus amidated
DDPKLYDKDLGSALGDTVVGQMDAAWSL

SEQ ID NO: 3215 - protein, 28 aa, Artificial Sequence
  Description of Artificial Sequence: Synthetic peptide
DDPKLYDKDLGSALGDTVVGQMDAAWSL

SEQ ID NO: 3216 - protein, 28 aa, Artificial Sequence
  Description of Artificial Sequence: Synthetic peptide
  C-terminus amidated
DDPKLYDKDLGSALGDTVVGQMDAATSL

SEQ ID NO: 3217 - protein, 28 aa, Artificial Sequence
  Description of Artificial Sequence: Synthetic peptide
DDPKLYDKDLGSALGDTVVGQMDAATSL

SEQ ID NO: 3218 - protein, 28 aa, Artificial Sequence
  Description of Artificial Sequence: Synthetic peptide
  C-terminus amidated
DDPKLYDKDLGSAMWDWVVAWVDAAWSL

SEQ ID NO: 3219 - protein, 28 aa, Artificial Sequence
  Description of Artificial Sequence: Synthetic peptide
DDPKLYDKDLGSAMWDWVVAWVDAAWSL

SEQ ID NO: 3220 - protein, 28 aa, Artificial Sequence
  Description of Artificial Sequence: Synthetic peptide
  C-terminus amidated
DDPKLYDKDLGSAMWDWVVAWVDAATSL

SEQ ID NO: 3221 - protein, 28 aa, Artificial Sequence
  Description of Artificial Sequence: Synthetic peptide
DDPKLYDKDLGSAMWDWVVAWVDAATSL

SEQ ID NO: 3222 - protein, 28 aa, Artificial Sequence
  Description of Artificial Sequence: Synthetic peptide
  C-terminus amidated
DDPKLYDKDLGSAMWDWVVAWLDAAWSL

SEQ ID NO: 3223 - protein, 28 aa, Artificial Sequence
  Description of Artificial Sequence: Synthetic peptide
DDPKLYDKDLGSAMWDWVVAWLDAAWSL

SEQ ID NO: 3224 - protein, 28 aa, Artificial Sequence
  Description of Artificial Sequence: Synthetic peptide
  C-terminus amidated
DDPKLYDKDLGSAMWDWVVAWLDAATSL

SEQ ID NO: 3225 - protein, 28 aa, Artificial Sequence
  Description of Artificial Sequence: Synthetic peptide
DDPKLYDKDLGSAMWDWVVAWLDAATSL

SEQ ID NO: 3226 - protein, 28 aa, Artificial Sequence
  Description of Artificial Sequence: Synthetic peptide
  C-terminus amidated
DDPKLYDKDLGSAMWDWVVAWMDAAWSL

SEQ ID NO: 3227 - protein, 28 aa, Artificial Sequence
  Description of Artificial Sequence: Synthetic peptide
DDPKLYDKDLGSAMWDWVVAWMDAAWSL

SEQ ID NO: 3228 - protein, 28 aa, Artificial Sequence
  Description of Artificial Sequence: Synthetic peptide
  C-terminus amidated
DDPKLYDKDLGSAMWDWVVAWMDAATSL

SEQ ID NO: 3229 - protein, 28 aa, Artificial Sequence
  Description of Artificial Sequence: Synthetic peptide
DDPKLYDKDLGSAMWDWVVAWMDAATSL

SEQ ID NO: 3230 - protein, 28 aa, Artificial Sequence
  Description of Artificial Sequence: Synthetic peptide
  C-terminus amidated
DDPKLYDKDLGSAMWDWVVAQVDAAWSL

SEQ ID NO: 3231 - protein, 28 aa, Artificial Sequence
  Description of Artificial Sequence: Synthetic peptide
DDPKLYDKDLGSAMWDWVVAQVDAAWSL

SEQ ID NO: 3232 - protein, 28 aa, Artificial Sequence
  Description of Artificial Sequence: Synthetic peptide
  C-terminus amidated
DDPKLYDKDLGSAMWDWVVAQVDAATSL

SEQ ID NO: 3233 - protein, 28 aa, Artificial Sequence
  Description of Artificial Sequence: Synthetic peptide
DDPKLYDKDLGSAMWDWVVAQVDAATSL

SEQ ID NO: 3234 - protein, 28 aa, Artificial Sequence
  Description of Artificial Sequence: Synthetic peptide
  C-terminus amidated
DDPKLYDKDLGSAMWDWVVAQLDAAWSL

SEQ ID NO: 3235 - protein, 28 aa, Artificial Sequence
  Description of Artificial Sequence: Synthetic peptide
DDPKLYDKDLGSAMWDWVVAQLDAAWSL

SEQ ID NO: 3236 - protein, 28 aa, Artificial Sequence
  Description of Artificial Sequence: Synthetic peptide
  C-terminus amidated
DDPKLYDKDLGSAMWDWVVAQLDAATSL

SEQ ID NO: 3237 - protein, 28 aa, Artificial Sequence
  Description of Artificial Sequence: Synthetic peptide
DDPKLYDKDLGSAMWDWVVAQLDAATSL

SEQ ID NO: 3238 - protein, 28 aa, Artificial Sequence
  Description of Artificial Sequence: Synthetic peptide
  C-terminus amidated
DDPKLYDKDLGSAMWDWVVAQMDAAWSL

SEQ ID NO: 3239 - protein, 28 aa, Artificial Sequence
  Description of Artificial Sequence: Synthetic peptide
DDPKLYDKDLGSAMWDWVVAQMDAAWSL

SEQ ID NO: 3240 - protein, 28 aa, Artificial Sequence
  Description of Artificial Sequence: Synthetic peptide
  C-terminus amidated
DDPKLYDKDLGSAMWDWVVAQMDAATSL

SEQ ID NO: 3241 - protein, 28 aa, Artificial Sequence
  Description of Artificial Sequence: Synthetic peptide
DDPKLYDKDLGSAMWDWVVAQMDAATSL

SEQ ID NO: 3242 - protein, 28 aa, Artificial Sequence
  Description of Artificial Sequence: Synthetic peptide
  C-terminus amidated
DDPKLYDKDLGSAMWDWVVGWVDAAWSL

SEQ ID NO: 3243 - protein, 28 aa, Artificial Sequence
  Description of Artificial Sequence: Synthetic peptide
DDPKLYDKDLGSAMWDWVVGWVDAAWSL

SEQ ID NO: 3244 - protein, 28 aa, Artificial Sequence
  Description of Artificial Sequence: Synthetic peptide
  C-terminus amidated
DDPKLYDKDLGSAMWDWVVGWVDAATSL

SEQ ID NO: 3245 - protein, 28 aa, Artificial Sequence
  Description of Artificial Sequence: Synthetic peptide
DDPKLYDKDLGSAMWDWVVGWVDAATSL

SEQ ID NO: 3246 - protein, 28 aa, Artificial Sequence
  Description of Artificial Sequence: Synthetic peptide
  C-terminus amidated
DDPKLYDKDLGSAMWDWVVGWLDAAWSL

SEQ ID NO: 3247 - protein, 28 aa, Artificial Sequence
  Description of Artificial Sequence: Synthetic peptide
DDPKLYDKDLGSAMWDWVVGWLDAAWSL

SEQ ID NO: 3248 - protein, 28 aa, Artificial Sequence
  Description of Artificial Sequence: Synthetic peptide
  C-terminus amidated
DDPKLYDKDLGSAMWDWVVGWLDAATSL

SEQ ID NO: 3249 - protein, 28 aa, Artificial Sequence
  Description of Artificial Sequence: Synthetic peptide
DDPKLYDKDLGSAMWDWVVGWLDAATSL

SEQ ID NO: 3250 - protein, 28 aa, Artificial Sequence
  Description of Artificial Sequence: Synthetic peptide
  C-terminus amidated
DDPKLYDKDLGSAMWDWVVGWMDAAWSL

SEQ ID NO: 3251 - protein, 28 aa, Artificial Sequence
  Description of Artificial Sequence: Synthetic peptide
DDPKLYDKDLGSAMWDWVVGWMDAAWSL

SEQ ID NO: 3252 - protein, 28 aa, Artificial Sequence
  Description of Artificial Sequence: Synthetic peptide
  C-terminus amidated
DDPKLYDKDLGSAMWDWVVGWMDAATSL

SEQ ID NO: 3253 - protein, 28 aa, Artificial Sequence
  Description of Artificial Sequence: Synthetic peptide
DDPKLYDKDLGSAMWDWVVGWMDAATSL

SEQ ID NO: 3254 - protein, 28 aa, Artificial Sequence
  Description of Artificial Sequence: Synthetic peptide
  C-terminus amidated
DDPKLYDKDLGSAMWDWVVGQVDAAWSL

SEQ ID NO: 3255 - protein, 28 aa, Artificial Sequence
  Description of Artificial Sequence: Synthetic peptide
DDPKLYDKDLGSAMWDWVVGQVDAAWSL

SEQ ID NO: 3256 - protein, 28 aa, Artificial Sequence
  Description of Artificial Sequence: Synthetic peptide
  C-terminus amidated
DDPKLYDKDLGSAMWDWVVGQVDAATSL

SEQ ID NO: 3257 - protein, 28 aa, Artificial Sequence
  Description of Artificial Sequence: Synthetic peptide
DDPKLYDKDLGSAMWDWVVGQVDAATSL

SEQ ID NO: 3258 - protein, 28 aa, Artificial Sequence
  Description of Artificial Sequence: Synthetic peptide
  C-terminus amidated
DDPKLYDKDLGSAMWDWVVGQLDAAWSL

SEQ ID NO: 3259 - protein, 28 aa, Artificial Sequence
  Description of Artificial Sequence: Synthetic peptide
DDPKLYDKDLGSAMWDWVVGQLDAAWSL

SEQ ID NO: 3260 - protein, 28 aa, Artificial Sequence
  Description of Artificial Sequence: Synthetic peptide
  C-terminus amidated
DDPKLYDKDLGSAMWDWVVGQLDAATSL

SEQ ID NO: 3261 - protein, 28 aa, Artificial Sequence
  Description of Artificial Sequence: Synthetic peptide
DDPKLYDKDLGSAMWDWVVGQLDAATSL

SEQ ID NO: 3262 - protein, 28 aa, Artificial Sequence
  Description of Artificial Sequence: Synthetic peptide
  C-terminus amidated
DDPKLYDKDLGSAMWDWVVGQMDAAWSL

SEQ ID NO: 3263 - protein, 28 aa, Artificial Sequence
  Description of Artificial Sequence: Synthetic peptide
DDPKLYDKDLGSAMWDWVVGQMDAAWSL

SEQ ID NO: 3264 - protein, 28 aa, Artificial Sequence
  Description of Artificial Sequence: Synthetic peptide
  C-terminus amidated
DDPKLYDKDLGSAMWDWVVGQMDAATSL

SEQ ID NO: 3265 - protein, 28 aa, Artificial Sequence
  Description of Artificial Sequence: Synthetic peptide
DDPKLYDKDLGSAMWDWVVGQMDAATSL

SEQ ID NO: 3266 - protein, 28 aa, Artificial Sequence
  Description of Artificial Sequence: Synthetic peptide
  C-terminus amidated
DDPKLYDKDLGSAMWDTVVAWVDAAWSL

SEQ ID NO: 3267 - protein, 28 aa, Artificial Sequence
  Description of Artificial Sequence: Synthetic peptide
DDPKLYDKDLGSAMWDTVVAWVDAAWSL

SEQ ID NO: 3268 - protein, 28 aa, Artificial Sequence
  Description of Artificial Sequence: Synthetic peptide
  C-terminus amidated
DDPKLYDKDLGSAMWDTVVAWVDAATSL

SEQ ID NO: 3269 - protein, 28 aa, Artificial Sequence
  Description of Artificial Sequence: Synthetic peptide
DDPKLYDKDLGSAMWDTVVAWVDAATSL

SEQ ID NO: 3270 - protein, 28 aa, Artificial Sequence
  Description of Artificial Sequence: Synthetic peptide
  C-terminus amidated
DDPKLYDKDLGSAMWDTVVAWLDAAWSL

SEQ ID NO: 3271 - protein, 28 aa, Artificial Sequence
  Description of Artificial Sequence: Synthetic peptide
DDPKLYDKDLGSAMWDTVVAWLDAAWSL

SEQ ID NO: 3272 - protein, 28 aa, Artificial Sequence
  Description of Artificial Sequence: Synthetic peptide
  C-terminus amidated
DDPKLYDKDLGSAMWDTVVAWLDAATSL

SEQ ID NO: 3273 - protein, 28 aa, Artificial Sequence
  Description of Artificial Sequence: Synthetic peptide
DDPKLYDKDLGSAMWDTVVAWLDAATSL

SEQ ID NO: 3274 - protein, 28 aa, Artificial Sequence
  Description of Artificial Sequence: Synthetic peptide
  C-terminus amidated
DDPKLYDKDLGSAMWDTVVAWMDAAWSL

SEQ ID NO: 3275 - protein, 28 aa, Artificial Sequence
  Description of Artificial Sequence: Synthetic peptide
DDPKLYDKDLGSAMWDTVVAWMDAAWSL

SEQ ID NO: 3276 - protein, 28 aa, Artificial Sequence
  Description of Artificial Sequence: Synthetic peptide
  C-terminus amidated
DDPKLYDKDLGSAMWDTVVAWMDAATSL

SEQ ID NO: 3277 - protein, 28 aa, Artificial Sequence
  Description of Artificial Sequence: Synthetic peptide
DDPKLYDKDLGSAMWDTVVAWMDAATSL

SEQ ID NO: 3278 - protein, 28 aa, Artificial Sequence
  Description of Artificial Sequence: Synthetic peptide
  C-terminus amidated
DDPKLYDKDLGSAMWDTVVAQVDAAWSL

SEQ ID NO: 3279 - protein, 28 aa, Artificial Sequence
  Description of Artificial Sequence: Synthetic peptide
DDPKLYDKDLGSAMWDTVVAQVDAAWSL

SEQ ID NO: 3280 - protein, 28 aa, Artificial Sequence
  Description of Artificial Sequence: Synthetic peptide
  C-terminus amidated
DDPKLYDKDLGSAMWDTVVAQVDAATSL

SEQ ID NO: 3281 - protein, 28 aa, Artificial Sequence
  Description of Artificial Sequence: Synthetic peptide
DDPKLYDKDLGSAMWDTVVAQVDAATSL

SEQ ID NO: 3282 - protein, 28 aa, Artificial Sequence
  Description of Artificial Sequence: Synthetic peptide
  C-terminus amidated
DDPKLYDKDLGSAMWDTVVAQLDAAWSL

SEQ ID NO: 3283 - protein, 28 aa, Artificial Sequence
  Description of Artificial Sequence: Synthetic peptide
DDPKLYDKDLGSAMWDTVVAQLDAAWSL

SEQ ID NO: 3284 - protein, 28 aa, Artificial Sequence
  Description of Artificial Sequence: Synthetic peptide
  C-terminus amidated
DDPKLYDKDLGSAMWDTVVAQLDAATSL

SEQ ID NO: 3285 - protein, 28 aa, Artificial Sequence
  Description of Artificial Sequence: Synthetic peptide
DDPKLYDKDLGSAMWDTVVAQLDAATSL

SEQ ID NO: 3286 - protein, 28 aa, Artificial Sequence
  Description of Artificial Sequence: Synthetic peptide
  C-terminus amidated
DDPKLYDKDLGSAMWDTVVAQMDAAWSL

SEQ ID NO: 3287 - protein, 28 aa, Artificial Sequence
  Description of Artificial Sequence: Synthetic peptide
DDPKLYDKDLGSAMWDTVVAQMDAAWSL

SEQ ID NO: 3288 - protein, 28 aa, Artificial Sequence
  Description of Artificial Sequence: Synthetic peptide
  C-terminus amidated
DDPKLYDKDLGSAMWDTVVAQMDAATSL

SEQ ID NO: 3289 - protein, 28 aa, Artificial Sequence
  Description of Artificial Sequence: Synthetic peptide
DDPKLYDKDLGSAMWDTVVAQMDAATSL

SEQ ID NO: 3290 - protein, 28 aa, Artificial Sequence
  Description of Artificial Sequence: Synthetic peptide
  C-terminus amidated
DDPKLYDKDLGSAMWDTVVGWVDAAWSL

SEQ ID NO: 3291 - protein, 28 aa, Artificial Sequence
  Description of Artificial Sequence: Synthetic peptide
DDPKLYDKDLGSAMWDTVVGWVDAAWSL

SEQ ID NO: 3292 - protein, 28 aa, Artificial Sequence
  Description of Artificial Sequence: Synthetic peptide
  C-terminus amidated
DDPKLYDKDLGSAMWDTVVGWVDAATSL

SEQ ID NO: 3293 - protein, 28 aa, Artificial Sequence
  Description of Artificial Sequence: Synthetic peptide
DDPKLYDKDLGSAMWDTVVGWVDAATSL

SEQ ID NO: 3294 - protein, 28 aa, Artificial Sequence
  Description of Artificial Sequence: Synthetic peptide
  C-terminus amidated
DDPKLYDKDLGSAMWDTVVGWLDAAWSL

SEQ ID NO: 3295 - protein, 28 aa, Artificial Sequence
  Description of Artificial Sequence: Synthetic peptide
DDPKLYDKDLGSAMWDTVVGWLDAAWSL

SEQ ID NO: 3296 - protein, 28 aa, Artificial Sequence
  Description of Artificial Sequence: Synthetic peptide
  C-terminus amidated
DDPKLYDKDLGSAMWDTVVGWLDAATSL

SEQ ID NO: 3297 - protein, 28 aa, Artificial Sequence
  Description of Artificial Sequence: Synthetic peptide
DDPKLYDKDLGSAMWDTVVGWLDAATSL

SEQ ID NO: 3298 - protein, 28 aa, Artificial Sequence
  Description of Artificial Sequence: Synthetic peptide
  C-terminus amidated
DDPKLYDKDLGSAMWDTVVGWMDAAWSL

SEQ ID NO: 3299 - protein, 28 aa, Artificial Sequence
  Description of Artificial Sequence: Synthetic peptide
DDPKLYDKDLGSAMWDTVVGWMDAAWSL

SEQ ID NO: 3300 - protein, 28 aa, Artificial Sequence
  Description of Artificial Sequence: Synthetic peptide
  C-terminus amidated
DDPKLYDKDLGSAMWDTVVGWMDAATSL

SEQ ID NO: 3301 - protein, 28 aa, Artificial Sequence
  Description of Artificial Sequence: Synthetic peptide
DDPKLYDKDLGSAMWDTVVGWMDAATSL

SEQ ID NO: 3302 - protein, 28 aa, Artificial Sequence
  Description of Artificial Sequence: Synthetic peptide
  C-terminus amidated
DDPKLYDKDLGSAMWDTVVGQVDAAWSL

SEQ ID NO: 3303 - protein, 28 aa, Artificial Sequence
  Description of Artificial Sequence: Synthetic peptide
DDPKLYDKDLGSAMWDTVVGQVDAAWSL

SEQ ID NO: 3304 - protein, 28 aa, Artificial Sequence
  Description of Artificial Sequence: Synthetic peptide
  C-terminus amidated
DDPKLYDKDLGSAMWDTVVGQVDAATSL

SEQ ID NO: 3305 - protein, 28 aa, Artificial Sequence
  Description of Artificial Sequence: Synthetic peptide
DDPKLYDKDLGSAMWDTVVGQVDAATSL

SEQ ID NO: 3306 - protein, 28 aa, Artificial Sequence
  Description of Artificial Sequence: Synthetic peptide
  C-terminus amidated
DDPKLYDKDLGSAMWDTVVGQLDAAWSL

SEQ ID NO: 3307 - protein, 28 aa, Artificial Sequence
  Description of Artificial Sequence: Synthetic peptide
DDPKLYDKDLGSAMWDTVVGQLDAAWSL

SEQ ID NO: 3308 - protein, 28 aa, Artificial Sequence
  Description of Artificial Sequence: Synthetic peptide
  C-terminus amidated
DDPKLYDKDLGSAMWDTVVGQLDAATSL

SEQ ID NO: 3309 - protein, 28 aa, Artificial Sequence
  Description of Artificial Sequence: Synthetic peptide
DDPKLYDKDLGSAMWDTVVGQLDAATSL

SEQ ID NO: 3310 - protein, 28 aa, Artificial Sequence
  Description of Artificial Sequence: Synthetic peptide
  C-terminus amidated
DDPKLYDKDLGSAMWDTVVGQMDAAWSL

SEQ ID NO: 3311 - protein, 28 aa, Artificial Sequence
  Description of Artificial Sequence: Synthetic peptide
DDPKLYDKDLGSAMWDTVVGQMDAAWSL

SEQ ID NO: 3312 - protein, 28 aa, Artificial Sequence
  Description of Artificial Sequence: Synthetic peptide
  C-terminus amidated
DDPKLYDKDLGSAMWDTVVGQMDAATSL

SEQ ID NO: 3313 - protein, 28 aa, Artificial Sequence
  Description of Artificial Sequence: Synthetic peptide
DDPKLYDKDLGSAMWDTVVGQMDAATSL

SEQ ID NO: 3314 - protein, 28 aa, Artificial Sequence
  Description of Artificial Sequence: Synthetic peptide
  C-terminus amidated
DDPKLYDKDLGSAMTDWVVAWVDAAWSL

SEQ ID NO: 3315 - protein, 28 aa, Artificial Sequence
  Description of Artificial Sequence: Synthetic peptide
DDPKLYDKDLGSAMTDWVVAWVDAAWSL

SEQ ID NO: 3316 - protein, 28 aa, Artificial Sequence
  Description of Artificial Sequence: Synthetic peptide
  C-terminus amidated
DDPKLYDKDLGSAMTDWVVAWVDAATSL

SEQ ID NO: 3317 - protein, 28 aa, Artificial Sequence
  Description of Artificial Sequence: Synthetic peptide
DDPKLYDKDLGSAMTDWVVAWVDAATSL

SEQ ID NO: 3318 - protein, 28 aa, Artificial Sequence
  Description of Artificial Sequence: Synthetic peptide
  C-terminus amidated
DDPKLYDKDLGSAMTDWVVAWLDAAWSL

SEQ ID NO: 3319 - protein, 28 aa, Artificial Sequence
  Description of Artificial Sequence: Synthetic peptide
DDPKLYDKDLGSAMTDWVVAWLDAAWSL

SEQ ID NO: 3320 - protein, 28 aa, Artificial Sequence
  Description of Artificial Sequence: Synthetic peptide
  C-terminus amidated
DDPKLYDKDLGSAMTDWVVAWLDAATSL

SEQ ID NO: 3321 - protein, 28 aa, Artificial Sequence
  Description of Artificial Sequence: Synthetic peptide
DDPKLYDKDLGSAMTDWVVAWLDAATSL

SEQ ID NO: 3322 - protein, 28 aa, Artificial Sequence
  Description of Artificial Sequence: Synthetic peptide
  C-terminus amidated
DDPKLYDKDLGSAMTDWVVAWMDAAWSL

SEQ ID NO: 3323 - protein, 28 aa, Artificial Sequence
  Description of Artificial Sequence: Synthetic peptide
DDPKLYDKDLGSAMTDWVVAWMDAAWSL

SEQ ID NO: 3324 - protein, 28 aa, Artificial Sequence
  Description of Artificial Sequence: Synthetic peptide
  C-terminus amidated
DDPKLYDKDLGSAMTDWVVAWMDAATSL

SEQ ID NO: 3325 - protein, 28 aa, Artificial Sequence
  Description of Artificial Sequence: Synthetic peptide
DDPKLYDKDLGSAMTDWVVAWMDAATSL

SEQ ID NO: 3326 - protein, 28 aa, Artificial Sequence
  Description of Artificial Sequence: Synthetic peptide
  C-terminus amidated
DDPKLYDKDLGSAMTDWVVAQVDAAWSL

SEQ ID NO: 3327 - protein, 28 aa, Artificial Sequence
  Description of Artificial Sequence: Synthetic peptide
DDPKLYDKDLGSAMTDWVVAQVDAAWSL

SEQ ID NO: 3328 - protein, 28 aa, Artificial Sequence
  Description of Artificial Sequence: Synthetic peptide
  C-terminus amidated
DDPKLYDKDLGSAMTDWVVAQVDAATSL

SEQ ID NO: 3329 - protein, 28 aa, Artificial Sequence
  Description of Artificial Sequence: Synthetic peptide
DDPKLYDKDLGSAMTDWVVAQVDAATSL

SEQ ID NO: 3330 - protein, 28 aa, Artificial Sequence
  Description of Artificial Sequence: Synthetic peptide
  C-terminus amidated
DDPKLYDKDLGSAMTDWVVAQLDAAWSL

SEQ ID NO: 3331 - protein, 28 aa, Artificial Sequence
  Description of Artificial Sequence: Synthetic peptide
DDPKLYDKDLGSAMTDWVVAQLDAAWSL

SEQ ID NO: 3332 - protein, 28 aa, Artificial Sequence
  Description of Artificial Sequence: Synthetic peptide
  C-terminus amidated
DDPKLYDKDLGSAMTDWVVAQLDAATSL

SEQ ID NO: 3333 - protein, 28 aa, Artificial Sequence
  Description of Artificial Sequence: Synthetic peptide
DDPKLYDKDLGSAMTDWVVAQLDAATSL

SEQ ID NO: 3334 - protein, 28 aa, Artificial Sequence
  Description of Artificial Sequence: Synthetic peptide
  C-terminus amidated
DDPKLYDKDLGSAMTDWVVAQMDAAWSL

SEQ ID NO: 3335 - protein, 28 aa, Artificial Sequence
  Description of Artificial Sequence: Synthetic peptide
DDPKLYDKDLGSAMTDWVVAQMDAAWSL

SEQ ID NO: 3336 - protein, 28 aa, Artificial Sequence
  Description of Artificial Sequence: Synthetic peptide
  C-terminus amidated
DDPKLYDKDLGSAMTDWVVAQMDAATSL

SEQ ID NO: 3337 - protein, 28 aa, Artificial Sequence
  Description of Artificial Sequence: Synthetic peptide
DDPKLYDKDLGSAMTDWVVAQMDAATSL

SEQ ID NO: 3338 - protein, 28 aa, Artificial Sequence
  Description of Artificial Sequence: Synthetic peptide
  C-terminus amidated
DDPKLYDKDLGSAMTDWVVGWVDAAWSL

SEQ ID NO: 3339 - protein, 28 aa, Artificial Sequence
  Description of Artificial Sequence: Synthetic peptide
DDPKLYDKDLGSAMTDWVVGWVDAAWSL

SEQ ID NO: 3340 - protein, 28 aa, Artificial Sequence
  Description of Artificial Sequence: Synthetic peptide
  C-terminus amidated
DDPKLYDKDLGSAMTDWVVGWVDAATSL

SEQ ID NO: 3341 - protein, 28 aa, Artificial Sequence
  Description of Artificial Sequence: Synthetic peptide
DDPKLYDKDLGSAMTDWVVGWVDAATSL

SEQ ID NO: 3342 - protein, 28 aa, Artificial Sequence
  Description of Artificial Sequence: Synthetic peptide
  C-terminus amidated
DDPKLYDKDLGSAMTDWVVGWLDAAWSL

SEQ ID NO: 3343 - protein, 28 aa, Artificial Sequence
  Description of Artificial Sequence: Synthetic peptide
DDPKLYDKDLGSAMTDWVVGWLDAAWSL

SEQ ID NO: 3344 - protein, 28 aa, Artificial Sequence
  Description of Artificial Sequence: Synthetic peptide
  C-terminus amidated
DDPKLYDKDLGSAMTDWVVGWLDAATSL

SEQ ID NO: 3345 - protein, 28 aa, Artificial Sequence
  Description of Artificial Sequence: Synthetic peptide
DDPKLYDKDLGSAMTDWVVGWLDAATSL

SEQ ID NO: 3346 - protein, 28 aa, Artificial Sequence
  Description of Artificial Sequence: Synthetic peptide
  C-terminus amidated
DDPKLYDKDLGSAMTDWVVGWMDAAWSL

SEQ ID NO: 3347 - protein, 28 aa, Artificial Sequence
  Description of Artificial Sequence: Synthetic peptide
DDPKLYDKDLGSAMTDWVVGWMDAAWSL

SEQ ID NO: 3348 - protein, 28 aa, Artificial Sequence
  Description of Artificial Sequence: Synthetic peptide
  C-terminus amidated
DDPKLYDKDLGSAMTDWVVGWMDAATSL

SEQ ID NO: 3349 - protein, 28 aa, Artificial Sequence
  Description of Artificial Sequence: Synthetic peptide
DDPKLYDKDLGSAMTDWVVGWMDAATSL

SEQ ID NO: 3350 - protein, 28 aa, Artificial Sequence
  Description of Artificial Sequence: Synthetic peptide
  C-terminus amidated
DDPKLYDKDLGSAMTDWVVGQVDAAWSL

SEQ ID NO: 3351 - protein, 28 aa, Artificial Sequence
  Description of Artificial Sequence: Synthetic peptide
DDPKLYDKDLGSAMTDWVVGQVDAAWSL

SEQ ID NO: 3352 - protein, 28 aa, Artificial Sequence
  Description of Artificial Sequence: Synthetic peptide
  C-terminus amidated
DDPKLYDKDLGSAMTDWVVGQVDAATSL

SEQ ID NO: 3353 - protein, 28 aa, Artificial Sequence
  Description of Artificial Sequence: Synthetic peptide
DDPKLYDKDLGSAMTDWVVGQVDAATSL

SEQ ID NO: 3354 - protein, 28 aa, Artificial Sequence
  Description of Artificial Sequence: Synthetic peptide
  C-terminus amidated
DDPKLYDKDLGSAMTDWVVGQLDAAWSL

SEQ ID NO: 3355 - protein, 28 aa, Artificial Sequence
  Description of Artificial Sequence: Synthetic peptide
DDPKLYDKDLGSAMTDWVVGQLDAAWSL

SEQ ID NO: 3356 - protein, 28 aa, Artificial Sequence
  Description of Artificial Sequence: Synthetic peptide
  C-terminus amidated
DDPKLYDKDLGSAMTDWVVGQLDAATSL

SEQ ID NO: 3357 - protein, 28 aa, Artificial Sequence
  Description of Artificial Sequence: Synthetic peptide
DDPKLYDKDLGSAMTDWVVGQLDAATSL

SEQ ID NO: 3358 - protein, 28 aa, Artificial Sequence
  Description of Artificial Sequence: Synthetic peptide
  C-terminus amidated
DDPKLYDKDLGSAMTDWVVGQMDAAWSL

SEQ ID NO: 3359 - protein, 28 aa, Artificial Sequence
  Description of Artificial Sequence: Synthetic peptide
DDPKLYDKDLGSAMTDWVVGQMDAAWSL

SEQ ID NO: 3360 - protein, 28 aa, Artificial Sequence
  Description of Artificial Sequence: Synthetic peptide
  C-terminus amidated
DDPKLYDKDLGSAMTDWVVGQMDAATSL

SEQ ID NO: 3361 - protein, 28 aa, Artificial Sequence
  Description of Artificial Sequence: Synthetic peptide
DDPKLYDKDLGSAMTDWVVGQMDAATSL

SEQ ID NO: 3362 - protein, 28 aa, Artificial Sequence
  Description of Artificial Sequence: Synthetic peptide
  C-terminus amidated
DDPKLYDKDLGSAMTDTVVAWVDAAWSL

SEQ ID NO: 3363 - protein, 28 aa, Artificial Sequence
  Description of Artificial Sequence: Synthetic peptide
DDPKLYDKDLGSAMTDTVVAWVDAAWSL

SEQ ID NO: 3364 - protein, 28 aa, Artificial Sequence
  Description of Artificial Sequence: Synthetic peptide
  C-terminus amidated
DDPKLYDKDLGSAMTDTVVAWVDAATSL

SEQ ID NO: 3365 - protein, 28 aa, Artificial Sequence
  Description of Artificial Sequence: Synthetic peptide
DDPKLYDKDLGSAMTDTVVAWVDAATSL

SEQ ID NO: 3366 - protein, 28 aa, Artificial Sequence
  Description of Artificial Sequence: Synthetic peptide
  C-terminus amidated
DDPKLYDKDLGSAMTDTVVAWLDAAWSL

SEQ ID NO: 3367 - protein, 28 aa, Artificial Sequence
  Description of Artificial Sequence: Synthetic peptide
DDPKLYDKDLGSAMTDTVVAWLDAAWSL

SEQ ID NO: 3368 - protein, 28 aa, Artificial Sequence
  Description of Artificial Sequence: Synthetic peptide
  C-terminus amidated
DDPKLYDKDLGSAMTDTVVAWLDAATSL

SEQ ID NO: 3369 - protein, 28 aa, Artificial Sequence
  Description of Artificial Sequence: Synthetic peptide
DDPKLYDKDLGSAMTDTVVAWLDAATSL

SEQ ID NO: 3370 - protein, 28 aa, Artificial Sequence
  Description of Artificial Sequence: Synthetic peptide
  C-terminus amidated
DDPKLYDKDLGSAMTDTVVAWMDAAWSL

SEQ ID NO: 3371 - protein, 28 aa, Artificial Sequence
  Description of Artificial Sequence: Synthetic peptide
DDPKLYDKDLGSAMTDTVVAWMDAAWSL

SEQ ID NO: 3372 - protein, 28 aa, Artificial Sequence
  Description of Artificial Sequence: Synthetic peptide
  C-terminus amidated
DDPKLYDKDLGSAMTDTVVAWMDAATSL

SEQ ID NO: 3373 - protein, 28 aa, Artificial Sequence
  Description of Artificial Sequence: Synthetic peptide
DDPKLYDKDLGSAMTDTVVAWMDAATSL

SEQ ID NO: 3374 - protein, 28 aa, Artificial Sequence
  Description of Artificial Sequence: Synthetic peptide
  C-terminus amidated
DDPKLYDKDLGSAMTDTVVAQVDAAWSL

SEQ ID NO: 3375 - protein, 28 aa, Artificial Sequence
  Description of Artificial Sequence: Synthetic peptide
DDPKLYDKDLGSAMTDTVVAQVDAAWSL

SEQ ID NO: 3376 - protein, 28 aa, Artificial Sequence
  Description of Artificial Sequence: Synthetic peptide
  C-terminus amidated
DDPKLYDKDLGSAMTDTVVAQVDAATSL

SEQ ID NO: 3377 - protein, 28 aa, Artificial Sequence
  Description of Artificial Sequence: Synthetic peptide
DDPKLYDKDLGSAMTDTVVAQVDAATSL

SEQ ID NO: 3378 - protein, 28 aa, Artificial Sequence
  Description of Artificial Sequence: Synthetic peptide
  C-terminus amidated
DDPKLYDKDLGSAMTDTVVAQLDAAWSL

SEQ ID NO: 3379 - protein, 28 aa, Artificial Sequence
  Description of Artificial Sequence: Synthetic peptide
DDPKLYDKDLGSAMTDTVVAQLDAAWSL

SEQ ID NO: 3380 - protein, 28 aa, Artificial Sequence
  Description of Artificial Sequence: Synthetic peptide
  C-terminus amidated
DDPKLYDKDLGSAMTDTVVAQLDAATSL

SEQ ID NO: 3381 - protein, 28 aa, Artificial Sequence
  Description of Artificial Sequence: Synthetic peptide
DDPKLYDKDLGSAMTDTVVAQLDAATSL

SEQ ID NO: 3382 - protein, 28 aa, Artificial Sequence
  Description of Artificial Sequence: Synthetic peptide
  C-terminus amidated
DDPKLYDKDLGSAMTDTVVAQMDAAWSL

SEQ ID NO: 3383 - protein, 28 aa, Artificial Sequence
  Description of Artificial Sequence: Synthetic peptide
DDPKLYDKDLGSAMTDTVVAQMDAAWSL

SEQ ID NO: 3384 - protein, 28 aa, Artificial Sequence
  Description of Artificial Sequence: Synthetic peptide
  C-terminus amidated
DDPKLYDKDLGSAMTDTVVAQMDAATSL

SEQ ID NO: 3385 - protein, 28 aa, Artificial Sequence
  Description of Artificial Sequence: Synthetic peptide
DDPKLYDKDLGSAMTDTVVAQMDAATSL

SEQ ID NO: 3386 - protein, 28 aa, Artificial Sequence
  Description of Artificial Sequence: Synthetic peptide
  C-terminus amidated
DDPKLYDKDLGSAMTDTVVGWVDAAWSL

SEQ ID NO: 3387 - protein, 28 aa, Artificial Sequence
  Description of Artificial Sequence: Synthetic peptide
DDPKLYDKDLGSAMTDTVVGWVDAAWSL

SEQ ID NO: 3388 - protein, 28 aa, Artificial Sequence
  Description of Artificial Sequence: Synthetic peptide
  C-terminus amidated
DDPKLYDKDLGSAMTDTVVGWVDAATSL

SEQ ID NO: 3389 - protein, 28 aa, Artificial Sequence
  Description of Artificial Sequence: Synthetic peptide
DDPKLYDKDLGSAMTDTVVGWVDAATSL

SEQ ID NO: 3390 - protein, 28 aa, Artificial Sequence
  Description of Artificial Sequence: Synthetic peptide
  C-terminus amidated
DDPKLYDKDLGSAMTDTVVGWLDAAWSL

SEQ ID NO: 3391 - protein, 28 aa, Artificial Sequence
  Description of Artificial Sequence: Synthetic peptide
DDPKLYDKDLGSAMTDTVVGWLDAAWSL

SEQ ID NO: 3392 - protein, 28 aa, Artificial Sequence
  Description of Artificial Sequence: Synthetic peptide
  C-terminus amidated
DDPKLYDKDLGSAMTDTVVGWLDAATSL

SEQ ID NO: 3393 - protein, 28 aa, Artificial Sequence
  Description of Artificial Sequence: Synthetic peptide
DDPKLYDKDLGSAMTDTVVGWLDAATSL

SEQ ID NO: 3394 - protein, 28 aa, Artificial Sequence
  Description of Artificial Sequence: Synthetic peptide
  C-terminus amidated
DDPKLYDKDLGSAMTDTVVGWMDAAWSL

SEQ ID NO: 3395 - protein, 28 aa, Artificial Sequence
  Description of Artificial Sequence: Synthetic peptide
DDPKLYDKDLGSAMTDTVVGWMDAAWSL

SEQ ID NO: 3396 - protein, 28 aa, Artificial Sequence
  Description of Artificial Sequence: Synthetic peptide
  C-terminus amidated
DDPKLYDKDLGSAMTDTVVGWMDAATSL

SEQ ID NO: 3397 - protein, 28 aa, Artificial Sequence
  Description of Artificial Sequence: Synthetic peptide
DDPKLYDKDLGSAMTDTVVGWMDAATSL

SEQ ID NO: 3398 - protein, 28 aa, Artificial Sequence
  Description of Artificial Sequence: Synthetic peptide
  C-terminus amidated
DDPKLYDKDLGSAMTDTVVGQVDAAWSL

SEQ ID NO: 3399 - protein, 28 aa, Artificial Sequence
  Description of Artificial Sequence: Synthetic peptide
DDPKLYDKDLGSAMTDTVVGQVDAAWSL

SEQ ID NO: 3400 - protein, 28 aa, Artificial Sequence
  Description of Artificial Sequence: Synthetic peptide
  C-terminus amidated
DDPKLYDKDLGSAMTDTVVGQVDAATSL

SEQ ID NO: 3401 - protein, 28 aa, Artificial Sequence
  Description of Artificial Sequence: Synthetic peptide
DDPKLYDKDLGSAMTDTVVGQVDAATSL

SEQ ID NO: 3402 - protein, 28 aa, Artificial Sequence
  Description of Artificial Sequence: Synthetic peptide
  C-terminus amidated
DDPKLYDKDLGSAMTDTVVGQLDAAWSL

SEQ ID NO: 3403 - protein, 28 aa, Artificial Sequence
  Description of Artificial Sequence: Synthetic peptide
DDPKLYDKDLGSAMTDTVVGQLDAAWSL

SEQ ID NO: 3404 - protein, 28 aa, Artificial Sequence
  Description of Artificial Sequence: Synthetic peptide
  C-terminus amidated
DDPKLYDKDLGSAMTDTVVGQLDAATSL

SEQ ID NO: 3405 - protein, 28 aa, Artificial Sequence
  Description of Artificial Sequence: Synthetic peptide
DDPKLYDKDLGSAMTDTVVGQLDAATSL

SEQ ID NO: 3406 - protein, 28 aa, Artificial Sequence
  Description of Artificial Sequence: Synthetic peptide
  C-terminus amidated
DDPKLYDKDLGSAMTDTVVGQMDAAWSL

SEQ ID NO: 3407 - protein, 28 aa, Artificial Sequence
  Description of Artificial Sequence: Synthetic peptide
DDPKLYDKDLGSAMTDTVVGQMDAAWSL

SEQ ID NO: 3408 - protein, 28 aa, Artificial Sequence
  Description of Artificial Sequence: Synthetic peptide
  C-terminus amidated
DDPKLYDKDLGSAMTDTVVGQMDAATSL

SEQ ID NO: 3409 - protein, 28 aa, Artificial Sequence
  Description of Artificial Sequence: Synthetic peptide
DDPKLYDKDLGSAMTDTVVGQMDAATSL

SEQ ID NO: 3410 - protein, 28 aa, Artificial Sequence
  Description of Artificial Sequence: Synthetic peptide
  C-terminus amidated
DDPKLYDKDLGSAMGDWVVAWVDAAWSL

SEQ ID NO: 3411 - protein, 28 aa, Artificial Sequence
  Description of Artificial Sequence: Synthetic peptide
DDPKLYDKDLGSAMGDWVVAWVDAAWSL

SEQ ID NO: 3412 - protein, 28 aa, Artificial Sequence
  Description of Artificial Sequence: Synthetic peptide
  C-terminus amidated
DDPKLYDKDLGSAMGDWVVAWVDAATSL

SEQ ID NO: 3413 - protein, 28 aa, Artificial Sequence
  Description of Artificial Sequence: Synthetic peptide
DDPKLYDKDLGSAMGDWVVAWVDAATSL

SEQ ID NO: 3414 - protein, 28 aa, Artificial Sequence
  Description of Artificial Sequence: Synthetic peptide
  C-terminus amidated
DDPKLYDKDLGSAMGDWVVAWLDAAWSL

SEQ ID NO: 3415 - protein, 28 aa, Artificial Sequence
  Description of Artificial Sequence: Synthetic peptide
DDPKLYDKDLGSAMGDWVVAWLDAAWSL

SEQ ID NO: 3416 - protein, 28 aa, Artificial Sequence
  Description of Artificial Sequence: Synthetic peptide
  C-terminus amidated
DDPKLYDKDLGSAMGDWVVAWLDAATSL

SEQ ID NO: 3417 - protein, 28 aa, Artificial Sequence
  Description of Artificial Sequence: Synthetic peptide
DDPKLYDKDLGSAMGDWVVAWLDAATSL

SEQ ID NO: 3418 - protein, 28 aa, Artificial Sequence
  Description of Artificial Sequence: Synthetic peptide
  C-terminus amidated
DDPKLYDKDLGSAMGDWVVAWMDAAWSL

SEQ ID NO: 3419 - protein, 28 aa, Artificial Sequence
  Description of Artificial Sequence: Synthetic peptide
DDPKLYDKDLGSAMGDWVVAWMDAAWSL

SEQ ID NO: 3420 - protein, 28 aa, Artificial Sequence
  Description of Artificial Sequence: Synthetic peptide
  C-terminus amidated
DDPKLYDKDLGSAMGDWVVAWMDAATSL

SEQ ID NO: 3421 - protein, 28 aa, Artificial Sequence
  Description of Artificial Sequence: Synthetic peptide
DDPKLYDKDLGSAMGDWVVAWMDAATSL

SEQ ID NO: 3422 - protein, 28 aa, Artificial Sequence
  Description of Artificial Sequence: Synthetic peptide
  C-terminus amidated
DDPKLYDKDLGSAMGDWVVAQVDAAWSL

SEQ ID NO: 3423 - protein, 28 aa, Artificial Sequence
  Description of Artificial Sequence: Synthetic peptide
DDPKLYDKDLGSAMGDWVVAQVDAAWSL

SEQ ID NO: 3424 - protein, 28 aa, Artificial Sequence
  Description of Artificial Sequence: Synthetic peptide
  C-terminus amidated
DDPKLYDKDLGSAMGDWVVAQVDAATSL

SEQ ID NO: 3425 - protein, 28 aa, Artificial Sequence
  Description of Artificial Sequence: Synthetic peptide
DDPKLYDKDLGSAMGDWVVAQVDAATSL

SEQ ID NO: 3426 - protein, 28 aa, Artificial Sequence
  Description of Artificial Sequence: Synthetic peptide
  C-terminus amidated
DDPKLYDKDLGSAMGDWVVAQLDAAWSL

SEQ ID NO: 3427 - protein, 28 aa, Artificial Sequence
  Description of Artificial Sequence: Synthetic peptide
DDPKLYDKDLGSAMGDWVVAQLDAAWSL

SEQ ID NO: 3428 - protein, 28 aa, Artificial Sequence
  Description of Artificial Sequence: Synthetic peptide
  C-terminus amidated
DDPKLYDKDLGSAMGDWVVAQLDAATSL

SEQ ID NO: 3429 - protein, 28 aa, Artificial Sequence
  Description of Artificial Sequence: Synthetic peptide
DDPKLYDKDLGSAMGDWVVAQLDAATSL

SEQ ID NO: 3430 - protein, 28 aa, Artificial Sequence
  Description of Artificial Sequence: Synthetic peptide
  C-terminus amidated
DDPKLYDKDLGSAMGDWVVAQMDAAWSL

SEQ ID NO: 3431 - protein, 28 aa, Artificial Sequence
  Description of Artificial Sequence: Synthetic peptide
DDPKLYDKDLGSAMGDWVVAQMDAAWSL

SEQ ID NO: 3432 - protein, 28 aa, Artificial Sequence
  Description of Artificial Sequence: Synthetic peptide
  C-terminus amidated
DDPKLYDKDLGSAMGDWVVAQMDAATSL

SEQ ID NO: 3433 - protein, 28 aa, Artificial Sequence
  Description of Artificial Sequence: Synthetic peptide
DDPKLYDKDLGSAMGDWVVAQMDAATSL

SEQ ID NO: 3434 - protein, 28 aa, Artificial Sequence
  Description of Artificial Sequence: Synthetic peptide
  C-terminus amidated
DDPKLYDKDLGSAMGDWVVGWVDAAWSL

SEQ ID NO: 3435 - protein, 28 aa, Artificial Sequence
  Description of Artificial Sequence: Synthetic peptide
DDPKLYDKDLGSAMGDWVVGWVDAAWSL

SEQ ID NO: 3436 - protein, 28 aa, Artificial Sequence
  Description of Artificial Sequence: Synthetic peptide
  C-terminus amidated
DDPKLYDKDLGSAMGDWVVGWVDAATSL

SEQ ID NO: 3437 - protein, 28 aa, Artificial Sequence
  Description of Artificial Sequence: Synthetic peptide
DDPKLYDKDLGSAMGDWVVGWVDAATSL

SEQ ID NO: 3438 - protein, 28 aa, Artificial Sequence
  Description of Artificial Sequence: Synthetic peptide
  C-terminus amidated
DDPKLYDKDLGSAMGDWVVGWLDAAWSL

SEQ ID NO: 3439 - protein, 28 aa, Artificial Sequence
  Description of Artificial Sequence: Synthetic peptide
DDPKLYDKDLGSAMGDWVVGWLDAAWSL

SEQ ID NO: 3440 - protein, 28 aa, Artificial Sequence
  Description of Artificial Sequence: Synthetic peptide
  C-terminus amidated
DDPKLYDKDLGSAMGDWVVGWLDAATSL

SEQ ID NO: 3441 - protein, 28 aa, Artificial Sequence
  Description of Artificial Sequence: Synthetic peptide
DDPKLYDKDLGSAMGDWVVGWLDAATSL

SEQ ID NO: 3442 - protein, 28 aa, Artificial Sequence
  Description of Artificial Sequence: Synthetic peptide
  C-terminus amidated
DDPKLYDKDLGSAMGDWVVGWMDAAWSL

SEQ ID NO: 3443 - protein, 28 aa, Artificial Sequence
  Description of Artificial Sequence: Synthetic peptide
DDPKLYDKDLGSAMGDWVVGWMDAAWSL

SEQ ID NO: 3444 - protein, 28 aa, Artificial Sequence
  Description of Artificial Sequence: Synthetic peptide
  C-terminus amidated
DDPKLYDKDLGSAMGDWVVGWMDAATSL

SEQ ID NO: 3445 - protein, 28 aa, Artificial Sequence
  Description of Artificial Sequence: Synthetic peptide
DDPKLYDKDLGSAMGDWVVGWMDAATSL

SEQ ID NO: 3446 - protein, 28 aa, Artificial Sequence
  Description of Artificial Sequence: Synthetic peptide
  C-terminus amidated
DDPKLYDKDLGSAMGDWVVGQVDAAWSL

SEQ ID NO: 3447 - protein, 28 aa, Artificial Sequence
  Description of Artificial Sequence: Synthetic peptide
DDPKLYDKDLGSAMGDWVVGQVDAAWSL

SEQ ID NO: 3448 - protein, 28 aa, Artificial Sequence
  Description of Artificial Sequence: Synthetic peptide
  C-terminus amidated
DDPKLYDKDLGSAMGDWVVGQVDAATSL

SEQ ID NO: 3449 - protein, 28 aa, Artificial Sequence
  Description of Artificial Sequence: Synthetic peptide
DDPKLYDKDLGSAMGDWVVGQVDAATSL

SEQ ID NO: 3450 - protein, 28 aa, Artificial Sequence
  Description of Artificial Sequence: Synthetic peptide
  C-terminus amidated
DDPKLYDKDLGSAMGDWVVGQLDAAWSL

SEQ ID NO: 3451 - protein, 28 aa, Artificial Sequence
  Description of Artificial Sequence: Synthetic peptide
DDPKLYDKDLGSAMGDWVVGQLDAAWSL

SEQ ID NO: 3452 - protein, 28 aa, Artificial Sequence
  Description of Artificial Sequence: Synthetic peptide
  C-terminus amidated
DDPKLYDKDLGSAMGDWVVGQLDAATSL

SEQ ID NO: 3453 - protein, 28 aa, Artificial Sequence
  Description of Artificial Sequence: Synthetic peptide
DDPKLYDKDLGSAMGDWVVGQLDAATSL

SEQ ID NO: 3454 - protein, 28 aa, Artificial Sequence
  Description of Artificial Sequence: Synthetic peptide
  C-terminus amidated
DDPKLYDKDLGSAMGDWVVGQMDAAWSL

SEQ ID NO: 3455 - protein, 28 aa, Artificial Sequence
  Description of Artificial Sequence: Synthetic peptide
DDPKLYDKDLGSAMGDWVVGQMDAAWSL

SEQ ID NO: 3456 - protein, 28 aa, Artificial Sequence
  Description of Artificial Sequence: Synthetic peptide
  C-terminus amidated
DDPKLYDKDLGSAMGDWVVGQMDAATSL

SEQ ID NO: 3457 - protein, 28 aa, Artificial Sequence
  Description of Artificial Sequence: Synthetic peptide
DDPKLYDKDLGSAMGDWVVGQMDAATSL

SEQ ID NO: 3458 - protein, 28 aa, Artificial Sequence
  Description of Artificial Sequence: Synthetic peptide
  C-terminus amidated
DDPKLYDKDLGSAMGDTVVAWVDAAWSL

SEQ ID NO: 3459 - protein, 28 aa, Artificial Sequence
  Description of Artificial Sequence: Synthetic peptide
DDPKLYDKDLGSAMGDTVVAWVDAAWSL

SEQ ID NO: 3460 - protein, 28 aa, Artificial Sequence
  Description of Artificial Sequence: Synthetic peptide
  C-terminus amidated
DDPKLYDKDLGSAMGDTVVAWVDAATSL

SEQ ID NO: 3461 - protein, 28 aa, Artificial Sequence
  Description of Artificial Sequence: Synthetic peptide
DDPKLYDKDLGSAMGDTVVAWVDAATSL

SEQ ID NO: 3462 - protein, 28 aa, Artificial Sequence
  Description of Artificial Sequence: Synthetic peptide
  C-terminus amidated
DDPKLYDKDLGSAMGDTVVAWLDAAWSL

SEQ ID NO: 3463 - protein, 28 aa, Artificial Sequence
  Description of Artificial Sequence: Synthetic peptide
DDPKLYDKDLGSAMGDTVVAWLDAAWSL

SEQ ID NO: 3464 - protein, 28 aa, Artificial Sequence
  Description of Artificial Sequence: Synthetic peptide
  C-terminus amidated
DDPKLYDKDLGSAMGDTVVAWLDAATSL

SEQ ID NO: 3465 - protein, 28 aa, Artificial Sequence
  Description of Artificial Sequence: Synthetic peptide
DDPKLYDKDLGSAMGDTVVAWLDAATSL

SEQ ID NO: 3466 - protein, 28 aa, Artificial Sequence
  Description of Artificial Sequence: Synthetic peptide
  C-terminus amidated
DDPKLYDKDLGSAMGDTVVAWMDAAWSL

SEQ ID NO: 3467 - protein, 28 aa, Artificial Sequence
  Description of Artificial Sequence: Synthetic peptide
DDPKLYDKDLGSAMGDTVVAWMDAAWSL

SEQ ID NO: 3468 - protein, 28 aa, Artificial Sequence
  Description of Artificial Sequence: Synthetic peptide
  C-terminus amidated
DDPKLYDKDLGSAMGDTVVAWMDAATSL

SEQ ID NO: 3469 - protein, 28 aa, Artificial Sequence
  Description of Artificial Sequence: Synthetic peptide
DDPKLYDKDLGSAMGDTVVAWMDAATSL

SEQ ID NO: 3470 - protein, 28 aa, Artificial Sequence
  Description of Artificial Sequence: Synthetic peptide
  C-terminus amidated
DDPKLYDKDLGSAMGDTVVAQVDAAWSL

SEQ ID NO: 3471 - protein, 28 aa, Artificial Sequence
  Description of Artificial Sequence: Synthetic peptide
DDPKLYDKDLGSAMGDTVVAQVDAAWSL

SEQ ID NO: 3472 - protein, 28 aa, Artificial Sequence
  Description of Artificial Sequence: Synthetic peptide
  C-terminus amidated
DDPKLYDKDLGSAMGDTVVAQVDAATSL

SEQ ID NO: 3473 - protein, 28 aa, Artificial Sequence
  Description of Artificial Sequence: Synthetic peptide
DDPKLYDKDLGSAMGDTVVAQVDAATSL

SEQ ID NO: 3474 - protein, 28 aa, Artificial Sequence
  Description of Artificial Sequence: Synthetic peptide
  C-terminus amidated
DDPKLYDKDLGSAMGDTVVAQLDAAWSL

SEQ ID NO: 3475 - protein, 28 aa, Artificial Sequence
  Description of Artificial Sequence: Synthetic peptide
DDPKLYDKDLGSAMGDTVVAQLDAAWSL

SEQ ID NO: 3476 - protein, 28 aa, Artificial Sequence
  Description of Artificial Sequence: Synthetic peptide
  C-terminus amidated
DDPKLYDKDLGSAMGDTVVAQLDAATSL

SEQ ID NO: 3477 - protein, 28 aa, Artificial Sequence
  Description of Artificial Sequence: Synthetic peptide
DDPKLYDKDLGSAMGDTVVAQLDAATSL

SEQ ID NO: 3478 - protein, 28 aa, Artificial Sequence
  Description of Artificial Sequence: Synthetic peptide
  C-terminus amidated
DDPKLYDKDLGSAMGDTVVAQMDAAWSL

SEQ ID NO: 3479 - protein, 28 aa, Artificial Sequence
  Description of Artificial Sequence: Synthetic peptide
DDPKLYDKDLGSAMGDTVVAQMDAAWSL

SEQ ID NO: 3480 - protein, 28 aa, Artificial Sequence
  Description of Artificial Sequence: Synthetic peptide
  C-terminus amidated
DDPKLYDKDLGSAMGDTVVAQMDAATSL

SEQ ID NO: 3481 - protein, 28 aa, Artificial Sequence
  Description of Artificial Sequence: Synthetic peptide
DDPKLYDKDLGSAMGDTVVAQMDAATSL

SEQ ID NO: 3482 - protein, 28 aa, Artificial Sequence
  Description of Artificial Sequence: Synthetic peptide
  C-terminus amidated
DDPKLYDKDLGSAMGDTVVGWVDAAWSL

SEQ ID NO: 3483 - protein, 28 aa, Artificial Sequence
  Description of Artificial Sequence: Synthetic peptide
DDPKLYDKDLGSAMGDTVVGWVDAAWSL

SEQ ID NO: 3484 - protein, 28 aa, Artificial Sequence
  Description of Artificial Sequence: Synthetic peptide
  C-terminus amidated
DDPKLYDKDLGSAMGDTVVGWVDAATSL

SEQ ID NO: 3485 - protein, 28 aa, Artificial Sequence
  Description of Artificial Sequence: Synthetic peptide
DDPKLYDKDLGSAMGDTVVGWVDAATSL

SEQ ID NO: 3486 - protein, 28 aa, Artificial Sequence
  Description of Artificial Sequence: Synthetic peptide
  C-terminus amidated
DDPKLYDKDLGSAMGDTVVGWLDAAWSL

SEQ ID NO: 3487 - protein, 28 aa, Artificial Sequence
  Description of Artificial Sequence: Synthetic peptide
DDPKLYDKDLGSAMGDTVVGWLDAAWSL

SEQ ID NO: 3488 - protein, 28 aa, Artificial Sequence
  Description of Artificial Sequence: Synthetic peptide
  C-terminus amidated
DDPKLYDKDLGSAMGDTVVGWLDAATSL

SEQ ID NO: 3489 - protein, 28 aa, Artificial Sequence
  Description of Artificial Sequence: Synthetic peptide
DDPKLYDKDLGSAMGDTVVGWLDAATSL

SEQ ID NO: 3490 - protein, 28 aa, Artificial Sequence
  Description of Artificial Sequence: Synthetic peptide
  C-terminus amidated
DDPKLYDKDLGSAMGDTVVGWMDAAWSL

SEQ ID NO: 3491 - protein, 28 aa, Artificial Sequence
  Description of Artificial Sequence: Synthetic peptide
DDPKLYDKDLGSAMGDTVVGWMDAAWSL

SEQ ID NO: 3492 - protein, 28 aa, Artificial Sequence
  Description of Artificial Sequence: Synthetic peptide
  C-terminus amidated
DDPKLYDKDLGSAMGDTVVGWMDAATSL

SEQ ID NO: 3493 - protein, 28 aa, Artificial Sequence
  Description of Artificial Sequence: Synthetic peptide
DDPKLYDKDLGSAMGDTVVGWMDAATSL

SEQ ID NO: 3494 - protein, 28 aa, Artificial Sequence
  Description of Artificial Sequence: Synthetic peptide
  C-terminus amidated
DDPKLYDKDLGSAMGDTVVGQVDAAWSL

SEQ ID NO: 3495 - protein, 28 aa, Artificial Sequence
  Description of Artificial Sequence: Synthetic peptide
DDPKLYDKDLGSAMGDTVVGQVDAAWSL

SEQ ID NO: 3496 - protein, 28 aa, Artificial Sequence
  Description of Artificial Sequence: Synthetic peptide
  C-terminus amidated
DDPKLYDKDLGSAMGDTVVGQVDAATSL

SEQ ID NO: 3497 - protein, 28 aa, Artificial Sequence
  Description of Artificial Sequence: Synthetic peptide
DDPKLYDKDLGSAMGDTVVGQVDAATSL

SEQ ID NO: 3498 - protein, 28 aa, Artificial Sequence
  Description of Artificial Sequence: Synthetic peptide
  C-terminus amidated
DDPKLYDKDLGSAMGDTVVGQLDAAWSL

SEQ ID NO: 3499 - protein, 28 aa, Artificial Sequence
  Description of Artificial Sequence: Synthetic peptide
DDPKLYDKDLGSAMGDTVVGQLDAAWSL

SEQ ID NO: 3500 - protein, 28 aa, Artificial Sequence
  Description of Artificial Sequence: Synthetic peptide
  C-terminus amidated
DDPKLYDKDLGSAMGDTVVGQLDAATSL

SEQ ID NO: 3501 - protein, 28 aa, Artificial Sequence
  Description of Artificial Sequence: Synthetic peptide
DDPKLYDKDLGSAMGDTVVGQLDAATSL

SEQ ID NO: 3502 - protein, 28 aa, Artificial Sequence
  Description of Artificial Sequence: Synthetic peptide
  C-terminus amidated
DDPKLYDKDLGSAMGDTVVGQMDAAWSL

SEQ ID NO: 3503 - protein, 28 aa, Artificial Sequence
  Description of Artificial Sequence: Synthetic peptide
DDPKLYDKDLGSAMGDTVVGQMDAAWSL

SEQ ID NO: 3504 - protein, 28 aa, Artificial Sequence
  Description of Artificial Sequence: Synthetic peptide
  C-terminus amidated
DDPKLYDKDLGSAMGDTVVGQMDAATSL

SEQ ID NO: 3505 - protein, 28 aa, Artificial Sequence
  Description of Artificial Sequence: Synthetic peptide
DDPKLYDKDLGSAMGDTVVGQMDAATSL

What is claimed is:

1. A peptide consisting of:
a modified amino acid sequence;
wherein the amino acid sequence is selected from the group consisting of: SEQ ID NOs: 16-32 and 35-47; and
wherein the modification is one or more selected from the group consisting of: (1) replacing or substituting one or more amino acid residues with another amino acid residue(s); (2) acetylating the N-terminus of the amino acid sequence; (3) amidating the C-terminus of the amino acid sequence; and (4) covalently bonding one or more PEG molecules to the amino acid sequence.

2. The peptide of claim 1, whereas said peptide comprises at least one improved pharmacokinetic property selected from the group consisting of (1) less susceptible to biotransformation in the patient, (2) excreted from the body of the patient at a slower rate (3) increased stability of its tertiary structure and (4) longer plasma half-life.

3. The peptide of claim 1, wherein said peptide has at least one pharmacologic activity of a wild-type cupredoxin.

4. The peptide of claim 1, wherein said peptide has at least one pharmacologic activity selected from the group consisting of (1) entering a mammalian cancer cell, (2) not entering non-cancerous mammalian cells, (3) entering pre-malignant mammalian cells, (4) killing mammalian cancer cells, (5) killing pre-malignant mammalian cells, (6) inhibiting the growth of a mammalian cancer cell, (7) inhibit HIV-I infection, (8) inhibiting parasitemia of malaria-infected red blood cells, (9) interfering with ephrin signaling system and (10) inhibiting angiogenesis.

5. The peptide of claim 1, which is less susceptible to hydrolysis.

6. The peptide of claim 1, wherein one or more asparagine or serine residues in the sequence of the peptide are replaced with another amino acid residue.

7. The peptide of claim 6, wherein the asparagine or serine residue is replaced with glutamic acid or threonine residues.

8. The peptide of claim 1, which is less susceptible to deamidation.

9. The peptide of claim 1, wherein one or more glycine residues of the peptide are replaced with another amino acid residue.

10. The peptide of claim 9, wherein one or more glycine residues are replaced with a threonine or alanine residue.

11. The peptide of claim 10, wherein one or more glycine residues in the peptide that are equivalent to residues 58 or 63 of *Pseudomonas aeruginosa* azurin (SEQ ID NO: 1) is replaced.

12. The peptide of claim 1, which consists of SEQ ID NO: 30.

13. The peptide of claim 1, which is less susceptible to oxidation.

14. The peptide of claim 1, wherein one or more methionine or cysteine residues of the peptide are replaced with another amino acid residue.

15. The peptide of claim 14, further comprising replacing one or more glycine residues with a leucine or valine residue.

16. The peptide of claim 15, wherein one or more methionine residues of the peptide that are equivalent to residues 56 or 64 of *Pseudomonas aeruginosa* azurin (SEQ ID NO: 1) is replaced.

17. The peptide of claim 16, which is SEQ ID NO: 31 or SEQ ID NO: 32.

18. The peptide of claim 1, which is less susceptible to diketopiperazine and pyroglutamic acid formation.

19. The peptide of claim 1, wherein a glycine residue in positions 1, 2 or 3 from the N-terminus of the peptide is replaced with another amino acid residue.

20. The peptide of claim 1, wherein a proline residue in position 3 from the N-terminus of the peptide is replaced with another amino acid residue.

21. The peptide of claim 1, wherein an asparagine residue at the N-terminus of the peptide is replaced with another amino acid residue.

22. The peptide of claim 1, which is less susceptible to racemization.

23. The peptide of claim 1, wherein one or more amino acid residues of the peptide are replaced with the D-isomer of the amino acid residue.

24. The peptide of claim 23, wherein all of the amino acid residues of the peptide are replaced with the D-isomers of the amino acid residues.

25. The peptide of claim 1, which consists of SEQ ID NO: 45.

26. The peptide of claim 1, which is less susceptible to degradation.

27. The peptide of claim 2, in which the peptide is modified to increase the stability of its tertiary structure.

28. The peptide of claim 27, wherein the peptide is modified to increase the stability of a least one α-helix.

29. The peptide of claim 1, wherein at least one amino acid residue of the peptide selected from the group consisting of glycine, proline, serine, aspartic acid, alanine, threonine, valine, glutamine, asparagine, cysteine, histidine, lysine, and arginine is replaced with an amino acid residue selected from the group consisting of leucine, isoleucine, phenylalanine, glutamic acid, tyrosine, tryptophan and methionine.

30. The peptide of claim 29, wherein the replaced residue of the peptide is within equivalent residues to residues 53-56, 58-64 and 68-70 of *P. aeruginosa* azurin (SEQ ID NO. 1).

31. The peptide of claim 29, in which the glutamine at a residue equivalent to residue 57 of *P. aeruginosa* azurin (SEQ ID NO. 1) is replaced with a tryptophan residue.

32. The peptide of claim 29, in which the threonine at a residue equivalent to residue 52 of *P. aeruginosa* azurin (SEQ ID NO. 1) is replaced with a tryptophan residue.

33. The peptide of claim 29, in which the threonine at a residue equivalent to residue 61 of *P. aeruginosa* azurin (SEQ ID NO. 1) is replaced with a tryptophan residue.

34. The peptide of claim 29, in which the glycine at a residue equivalent to residue 63 of *P. aeruginosa* azurin (SEQ ID NO. 1) is replaced with a tryptophan residue.

35. The peptide of claim 1, wherein one or more PEG molecules are covalently bonded to one or more cysteine residue of the peptide.

36. The peptide of claim 35, wherein one or more PEG molecules are covalently bonded to one or more cysteine residues equivalent to a residue selected from the group consisting of amino acid residues 3, 6, and 112 of *Pseudomonas aeruginosa* azurin (SEQ ID NO: 1).

37. The peptide of claim 1, wherein a cysteine residue is substituted into the peptide and is covalently bonded to a PEG molecule.

38. The peptide of claim 1, wherein one or more PEG molecules are covalently bonded to the peptide at one or more sites selected from the group consisting of lysine, cysteine, histidine, arginine, aspartic acid, glutamic acid, serine, threonine, tyrosine, N-terminal amino group, and C-terminal carboxylic acid.

39. The peptide of claim 38, wherein one or more lysine residues or C-terminal carboxylic acids are covalently bonded to a PEG molecule.

40. The peptide of claim 38, wherein one or more residues selected from the group consisting of lysine, cysteine, histidine, arginine, aspartic acid, glutamic acid, serine, threonine and tyrosine residue are substituted into the cupredoxin derived peptide and are covalently bonded to a PEG molecule.

41. The peptide of claim 1, wherein one or more amino groups of the peptide are covalently bonded to a PEG molecule.

42. The peptide of claim 1, wherein one or more PEG molecules are randomly covalently bonded to the peptide.

43. The peptide of claim 1, wherein the average molecular weight of the PEG molecules per peptide is about 200 to about 100,000 daltons.

44. The peptide of claim 43, wherein the peptide is covalently bonded to one or more branched PEG molecules.

45. The peptide of claim 44, wherein the branched PEG molecule is about 50 kDa.

46. The peptide of claim 43, wherein the peptide is covalently bonded to one or more linear PEG molecules.

47. The peptide of claim 46, wherein the linear PEG molecule is about 5 kDa.

48. A pharmaceutical composition, comprising the peptide of claim 1 and a pharmaceutically acceptable carrier.

49. A method, comprising administering to the mammal a therapeutically effective amount of the peptide of claim 1.

50. The method of claim 49, wherein said mammal is human.

* * * * *